United States Patent 7,745,391 (HUMAN THROMBOSPONDIN POLYPEPTIDE) - sequence listing, part 73

SEQ ID NO: 261503 - DNA, 403 bp, Homo sapiens
gcaatgacaaatgtggccagttcactttctgactccacatatccatgcaactgcttcagtatcatcattccaccagttctttgtcttctttaatctctggtgcctggtatgcctctgcattttcctagcattcatctctgctgtcatacctttcatcactattcacccttagatctcatgattctgtcctgcaatgtcttgtctgattactttctgtgtccctgtttggggaaaaaaaaaaccctccattccttggtgaatgtaagtcataggtctgactcctctcatgtctagtcacaggctgctaagcactcctgcaaaattcagacaacctgacattattataaattcataacctgaaatctcaattagatttattagcaatgtctaacaattctctgag

SEQ ID NO: 261504 - DNA, 396 bp, Homo sapiens
atgtctgatgttccatgggggatattttgtgcttaaaatgtattcagtttttatttttctttcatattctccaagtgacttttggcttctgcattccatacacattataagtggagttttggatgtgagtgtcagagcttgtttatgcaaagaaaatttcatcatactagatgcaactccttaatattctctcacccccaaattttagcaggagctatagaaagtgatttagatataatagtacctattatatgcattggtgtgggcataaaattaaattccaaattgcaaatagaactgctgcaagaaaataatatttcccaagacttattttacttaattgcatggaatattaatatgtataatgaaaataaaggagtctttcatctacttggt

SEQ ID NO: 261505 - DNA, 360 bp, Homo sapiens
gctggagctgagctctgccggcgggcacgtgctgcttgtcctcccaggagccttgggctgctccctccggaaggcacagggagaaataaggggtcctgagaaatgtcactgcctgcacccagcaaaagcccatttctttcttctccttctctttttatttttcttttcttcttgctctctcattgcccccagcccgccccactcctgttctctcctcctgcacctgcaattcctaaacaaccctgatgtttttctgatttccggtccctccgtcgagtctgtctttaaagatgagtactttttgctttgctactgttatttttttagataatttattgttaaataaagaattttaaagca

SEQ ID NO: 261506 - DNA, 133 bp, Homo sapiens
cttgcacgtcgggagtgggagagcctggtaaaggctgacagactatctcttaacaagtgaagattaatgccgcatctaaaactaagctctcctaagtgccgtcggtgcaacataaataccgagagtggggaaa

SEQ ID NO: 261507 - DNA, 400 bp, Homo sapiens
aaagaagtaaaactacctccatttccagatgacataatcttttatgtggaaaatcctaaggaacccataagaaacatgttaagcaaaattgaaggatacaagatcaatgtgcaaaactcttagctggccatggtggcacagttctgtagtcccagctactcaagaggctcaggcaggaggattgcttgagcccaggatttcaaggctgcagtgggccacaatcgcaccaccactttccagcctggggaacagagcaagactctgactcttaaaaaatcaaaaaggccaggtgcagtggctcataccttaaatcccaatgttttgggaggctgaggctggaggattacttgaagctaggagttcaagaccagcctgggcaaaataacaagaccgtatcttt

SEQ ID NO: 261508 - DNA, 255 bp, Homo sapiens
gccttaagcaaaaatcctgctaggttggtttagccagagccccctcattcctggtgtttccccttagtagtttttcctccactgatccccaccctgctccggctattaattcctacttttccttgctgtatatgtggctgagcccaacctctctccccaactgcagaatcgcatcacagtgggtcctatacctaaggcgatagttccttccccccacccctgacacccccaataaaatgtgccttcttaccatca

SEQ ID NO: 261509 - DNA, 618 bp, Homo sapiens
tactttgcagagcctgctcccaattttccctcaagctttttttcccattaatccccgcataaaccttccctatgcaacaaaagccctcttatcagtatttcctatatatgccttgtattttgactgccatcctttcctcacattgcactccagcctgggcgatagagcaagactccgtttcaatatatatgtatatataatttttgtgctgttatatgtacatgatccctttttcaccaaaattaagaatatgtttagtgagagccataaaactaaaaatgcttttgctagtttaaaactcggtttaacccatcatgataaagcagtttaatggtctgtttctaaaacttcaatttgatgcttagttttgatggctgtagaggtgaaaagaataaattcagaaagatttgtagcttcagatggaagaatcacagtgtcagttctgcttagtaacttgtgattgatccaacctatcaaccatgctgaatttttgttgttgaaatgcagggtatagtcttacaaactaatcaggtggtggcattttatatttttaacaaataggcttaagacccacctgaaattcttcatttgaaagatttttaaacaggttagaaaata

SEQ ID NO: 261510 - DNA, 562 bp, Homo sapiens
cacttggtgaccagaccaggcacggttgacacagtcacccagtagaggcaggcacatctcagaagggaactcctcacccagccaggcaaatgtgagtacaatgacagtaatagctcacgcttggatatcatgaactgcatgccagccattgttctaaaagctttacctagatgaattcttgtagtctcatcaccctatgagaatggtactattagactagactgtccatctcatagaagaagaatctgagggaggaagaaggcaaatgacttgtccaaagtcacacagtcagtcaacagcagaactgggcttcactctgttcacacgttgtgtgaagcacaacatggcttcagaaacctggcccctaaccaccacaccacactgcctctcaaggtaggcacccctgaagagaaactccagggacagccacatttgacccaggcagcaggacagagtcaggacctacacacacttgactgtaaatgtcacctcagagaggagggagggatgtttcgccacagccacggggggccgagctcggcctctgtgcatggacaccctc

SEQ ID NO: 261511 - DNA, 426 bp, Homo sapiens
agagtgaggaaggtgctcaagtttggaggaatccctcaagttaatgtaattcttagaggattgaagaggttaataaaaatcattatgaatcatttagcacaacctggaaatagtgctgccatgagaaatgaaaacttgaaatgatttctatcctggaggatttgagactcatgaaaactggagagacagtgttgtacaagaagaatttcttggcagattaaaaatataacccaaggagaagtaaaccactgaagattttaggactttataagtagaattattttctccagtctcttccttttcttgctcctattcatggagataaggcgatatttttttaaccacagaattcactaaagaatttgtgtctatttacaacctcagatgaatatatgaagaataaaagctgacaggaaaaaccatttc

SEQ ID NO: 261512 - DNA, 280 bp, Homo sapiens
ataatattgtcactttgaattttagtttctttcctttcacttcataacttcaaaagaagttttcagtagggcatggaacatttccaggattaagcagcaccagttcaacatgagattcagtcatattcagttcttcagagttcatggaatcctccaggtcctagactgttgctgaggatggttaatgtcaaataaattaaaaatactgaaaagaaaaaaataaaagtgtgtagatgctctatttttggactgagagcagtgaattggtagtggacatagg

SEQ ID NO: 261513 - DNA, 1050 bp, Homo sapiens
  misc_feature (1046)..(1046): n is a, c, g, or t
  misc_feature (1049)..(1049): n is a, c, g, or t
gaatggtgaataactgcatgactggcctggggtaggagactagactagaaggtgggttgagtccagcttgtaaagggtgaagtgtaccatgttgaggcaccagaagttgttactgttttctgttacgctttacctcttgactacagcattgcccccttatagaagaaatggacagacttctgaatcttacaggtttcttcctccagtcacatctcatgatttgttatgggtaaattgctttctttacatttttgtttccccatcaaaatctcacatcttactatacttaaaggacaaatatgttttgaagcatttaaagtattccccttttgggggttgctcttttagttggaaaactaagcaactgaggtaaagtagttgtagaagggaattgtctatttgatttgtgtctgttttgatagcttctgccttcctctaatttattctttcttttctttttttccaccacgtttattacataaaagacactgatattctattccatcattatcatcactaatgtttgtgacccactaaaatgatttcccagctcatcagtgggttacaatccatggtttgaaaaacactgcagcaaattttatgctaatctgccatggatacagggttaccatgtccatgataccttggcgtgaactagaaaaaggtgccctttcctcaagatgcctaattccatctgccaaaaaattgtcgtaatgtgctgactttgttagagtaggatactatcatatgccagagaatagttaaaaataagtaaaacttgatgtcaacattatgaatggtgtgcccagtaaataattatgttgtaagcaccctgtgcacaactgtacatatttgccctagtgtacactaaaccacatgacaaaataggttggaggtgtttgttcaatggataaattatctcagagtacctgtataccagggatttgtgacagctgttttgccttcttagggcttttctgctcatttccctattagagtagccagataaaatacagaacaccctttttaactggaatttatataancanc

SEQ ID NO: 261514 - DNA, 341 bp, Homo sapiens
ggcgggagccagaattgatgtcagtgaaggatgtttctttgcactgggctacttgtccagaacagaaagaactgggcatggtggtgggggtcaggtgatttcatatatatatatatatatatatatatatatacatttttttttttttttgagacggagtctcactctttgtcccaggctggagtacaatggtgtgatcttggctcactgcaacctccgcctccctccaacctcgcctcctgaggcaggagaatggtgtgaactggggaggcggagcttgcagtgagccgagatcatgccactgcccttcagcctgggcgacagaacaagactccatctca

SEQ ID NO: 261515 - DNA, 403 bp, Homo sapiens
agagatgggagtgtttgtattttacccacagcagcagactcagctctaggatatgtggggtgcatgtgtcttctgtctctcctggaactcagtatctgttcattcattcattgagtacctactgtgatcaaggcactggatggggcactatgacaatttctcttttggtattttttcaagatttgtttacttgatcttctagcccaggggtcagcaaaccacaggccatgggctagatccaggcctttgcctgtttctgtgcagcctcaatagttaagaatttttacatttttaaatgattaagaaggaaatcaaaagaagaacactattctgttacacaagaacattgtattcaatttgaattttggtgtcaataaataaagctctattagaacccagctgt

SEQ ID NO: 261516 - DNA, 401 bp, Homo sapiens
cagcaacgaggccaattatagcaactatgagagcaactataaatctttttgaacgggataaaagttttttaaggatttcatttactgtatgaatggatggagatgccgcccacggtctatttaaagacataggtatccagactccttccctggctttaattattaggacagtctgatttttattaaaggttgaactaatacaggtaaacaaatgacatgcggggcatgaaataaagtgtgtgtttatatcaagagtaacatttcctattgctagcagaaaaggtggccggacacaactttgaatccaaaaagtcctgttggaaagaaaagaaagagcatatttatttttacctccttcccctttatacttgttatatttaccctcccaaatttggattgaa

SEQ ID NO: 261517 - DNA, 358 bp, Homo sapiens
gaatggcagatacaaccagaccactttaaggaattgaggttgactttatagcaccaatacaaagccccttagaatgactggcttgatgtcctgtctacaaggatcctttacaaatttgctgtccttgtggtaagaagtaaagaatgtcactttctgatgggcccaggaacctcaagatatttggggaccttgagaagagaggactacacccattcataaaagtattacgggagagctggcaagatgtctgaataggaacagctccggcctgcagcacccagtgagatcaacacagaaggcaggtggttcatgcatttccaactgagcctccactggtgacacccaggcaaacaggtct

SEQ ID NO: 261518 - DNA, 104 bp, Homo sapiens
ccaggtgggccagagttagttcttactcacgctcccaaacatgggactctgtgctcacaggtaaccccaaacatcagagcaataaaaaccagggcaattccagt

SEQ ID NO: 261519 - DNA, 677 bp, Homo sapiens
cccccatcccatatctacccatttttttcaaaatgagaattttcaggttgggaatgtttattgaaataatacagctcctataccagtagtgtatattagttgtgtatgtgtagggcagaaaatatgttttagtttatagtttgaagaaaatgaagatttatctatctatctggatctggtagagagcactgcacttctccacattgcctagaaataatggattttagagctggatgtggaaatttaaaattgcctcctttgtatgtgtgagtgggtttatgtattgcaagaaatatatctgtggacacttgtgtgcttagaggaacggacgttggccaagcctgacaattattccctaatatctccagtttctttcttcccttcagcaataatgtcctaagttctgagcatatagccatctaaccaaaaaactccattttccagcatctctaatagctagggataatgctaccaagtgactacattctggacaaagggatttaatgggaaatgatgtattcaacttttgagagcaactttttaaagatgcttgcccttcacttttcatttttctttgtgaagagaacaggtgtctgttagcttcatcttcttcagccaagtatatgataactatatcataataaacgtcacagtaagtaagcaaagacaagactatg

SEQ ID NO: 261520 - DNA, 588 bp, Homo sapiens
gtagatgtagatttgcatttccctgctttgttgaaattaggagtgaccatatgacttgctttggccaacgtaatgtagttataagtaacactggccattttcaggtggaagatttaagaactagctgtgtgatttgctaggtcctcctttcctctacaacaggaactagtagcgcttttcatggaggctgttccatcagcctgggtcctggagtgagaatgatacagattagagaaataaagctctgttggattaagctgctgacatttaggagttgattgttacagcagcatagccctgactcacaagcctggataagctgtatctttgagggtccgatgatttcatgatttctgattctgattccccagttgtgtggcagcattccagagctgtgctgagactctccaagaagttgcttactaaatttttccagccaccatgtggttaagtgtttttaccgcaatttaaaattaacctcaaaaagatcaaggtcacatgtcgccatcttgaaaggaccagagatgtgctttgagtgcacatatcttggttagaaagccacctattgcattgtaccctaaagccctc

SEQ ID NO: 261521 - DNA, 488 bp, Homo sapiens
  misc_feature (50)..(50): n is a, c, g, or t
taccaatgtagcattactaataaacttaatgataattcactccagaaganaaatttttatacacttagagcttcagtcacaataaaaatttattaaactttaacttatttacatactttttgctgagacttataagatgaccaataacacttttaaaaacatacaaatctattacattaattctatggcagaagtggaatggaaatccaagttcaatgaataaaagggaaaatgtaaaattttcaaatattaaataacttgctattttaaagatggatggtggtaattatcaattcattaaggtatttacataccacttgatacatttcaaaaaacaatgtaacagttttattttaaaaagtcaatatttacactatgccagaaaatgaattctgagcaactttaaaatatgatgaataatcttatacgttaactttaaaagttaagttttcggctgggagcagtgtctcatgcctgtaatcccagca

SEQ ID NO: 261522 - DNA, 434 bp, Homo sapiens
tttctcaagaatcgttgctgtgaaagagccagtgaagtcacagagggtaaagtcaatggtcaaccttcctgattaatgaatattgattgagcattcaccatttaatagttagctccttctaagtctaatcgtttttagtttctcctgacacctgtcatgtaagaggctctatatgtgaggatagacttagggggcagttggttcctctttttggacacagaacaggaagaataaagagatctcagaaggaaaaggaaagtgggaggaggctgggtctgtgggttccccggtggatcacgctgaaagaatacctggcagacacttaatctctgcggcaaatgcatgaaagtagaaggatgaagccaactttccaaaaacttttatgaaattacttcagtgagaaaacctattaaataaattacagccattctata

SEQ ID NO: 261523 - DNA, 213 bp, Homo sapiens
ctgacctgatgtcctctccctgtgttctctgctctggttcaatcagttgcagcactcaccttctttgcctctccttgcacctgtgtagaaccaagcacacctgtaactttctttccctgaagctgattttcattctctgccagaatctccataactatctattgtgcgacattaagggatgttggtattacagtaaaatttccggagttagca

SEQ ID NO: 261524 - DNA, 423 bp, Homo sapiens
tcctgaaaacaaacacaaaaaacaaatactttctacacaaagtttccattttagtataaaataaagcaaaaaatgaagaacaacttggatattattaatagtgtggagattgctaaataagctatggtatataaattaacttagtgttatgccaccaaattaaaatggtttttatgaccacgcaatggctcatgcttgtaatcctagcacttgaggtcaggagttcaaaatcagcctgggaaacatgatgaggccccatctctacaaaatattaaaaaattagccaagcatggtggcatctgcctgtaatcccaggtggagctgaggcaggagcatttcttgagccttggagttggaggctgcagtgaaccatgatcatgcgggtgcactctagcttgggtgacagagtgaagcctgtctctt

SEQ ID NO: 261525 - DNA, 219 bp, Homo sapiens
tgtgaaataagatattttaacttttggcttcaaatcattattcatcgtaattctgttttcttaaatggctctcattcatggcagagatctttgaggtgagggtgttttaatcattgcatgcctagtacctgacacattgactggtatgtggtgtgagctcaatgatcttctgttaaattaatgaataaatgtactcagctgcccatccacttaggctca

SEQ ID NO: 261526 - DNA, 310 bp, Homo sapiens
ggatccatcagtgaaaagataagtaactcatgtagtatgttaggagatgattagtgcacaattcatttatgaatgacccataaaagaataagttgataaattagatttcatgaaaattaaaaaattctgcactttgaaaacattattaagaaaatgaaaaggtaagccacagactgtaagaaaatatttgcaaagaatatatctgataaagaacttatatccagaaaatacaaagaacttcgaaaactcaataatatacaacatattatttaaatgggcaaagatttgatcaggcacttcaccaaaaaaa

SEQ ID NO: 261527 - DNA, 177 bp, Homo sapiens
tatgctacatttttaaaaggaaaaataatgtgaaagttctatttgtagaacaaataatagtggcaatctcactttgatcttaaataacatagatatccaacttttatacaatttgaaacaaacaaaaccacaaccaaccttgtctttacaatcaattctttgtgactagagaagact

SEQ ID NO: 261528 - DNA, 418 bp, Homo sapiens
ggaggcccagactttaagtcctctgtgataggattgaggaggacagcctaggaacaatgagcctcctgctcgttgctgtctggtagctggccagaagtaggaaggggaaggaagagaggagcactgtggcctctcttctcctctccatgcctcgctgcaaaagtggagaagaaggaaggaaactagaaaggtgtcagaaaggggtgtcatgaaatctatgagcatccaaatttgattttttcagctagtcacaaatttaacataacaacctaaaattaaacttgaaacacagaaaaaacaaatacatttaagaaacatactggtaaatgatgaccttgtctatttaaaatccttactgactgtaaactctttgaacagcgattttgtgagccttatgtggctttttatcctgggtctt

SEQ ID NO: 261529 - DNA, 869 bp, Homo sapiens
attgacagacatttgtggagtgagtgctgggctgaggctgctgcatgaggctgattttgattcctgaggtcctggcccccagagataagaggcctcattcctggagttaagtaagatacagccccctcctcagatgactgcctgaagaatccattcataaatgagcgccatgtcataatcacctcacctgtctgtccagtaggattgaagaaggaaaaagtgggcggggcgtagtggctcacgcctgtaattccaactctttgggaggccgaggcgggcagatcacttgaggtcaggaattcgagaccagcctggccaacatggtgaagccccatcttcacaaaaaatacaaaaaattagcggggcgtggtggcaggtgccaataatctcagctacttgggaggctgaagcaggataattgcttgaacccaggaggtggaggttgtggtgagtcgagattgcaccactgcactccagcctgggcgacagagtaagactctgtctccaaaaaaaagaagaaaaaaaaaaaaaacatggaaaaaaaaagaaggaaaaagctgaaattccaaattatagagactttccttctcctaggcgccactctccaggacagtgactaaagaacagcttcaacaaacccctttctctccctttccctcccgggatctcacacacagggaaatggcaaggccttgggtgactgcgagaggaagcagagaccaccttgaaactcgggtgcattaagtccttggccttctcatcttaatctgctccagaataaaaaaatttaaaaaaaaaagtccgtggcctcactggtggtcaagagaccaccttgaaactcaggtgcattaagtccttggccttctgat

SEQ ID NO: 261530 - DNA, 316 bp, Homo sapiens
  misc_feature (303)..(303): n is a, c, g, or t
  misc_feature (309)..(309): n is a, c, g, or t
cctcttctcttctcgcttgggaacgccggtctcacctcggcttgcaatggaccccaactgctcctgcgccgctggaggctcctacgcctgcgccggctcctgcaagtgcaaaaagtgcaaatgcacctcctgcaagaagagctgctgctcctgttgccccctgggctgtgccaagtgtgcccagggctgcatccgcaaaggggcttcggaaaagtgcagctgctgtgcctgatgtcgggactgccctgctctcggatgaaaacagaatgacacgtaaagtccgggatttttttttctacaacnccgacncatttgc

SEQ ID NO: 261531 - DNA, 357 bp, Homo sapiens
cacatcagggaatctttagagagaggagcaatgagcctcaacctctttctcctgtttggtaactcttggtgctttcatgctaataatgctgtgaggaggtctggggctgctcctccatggggactgtgtccatcttgggaaggcccaggagtgagcagctttataagttagggagaaatagtatcattcccttgattttttcttccagggttaagattagctagtggttgaagattaagagatagaccaaccaagggcctgcatccagggcacagaagcagccctttgagtgacaaggggacaggtggtcaagctcaacttactggaacagtgtttttagacaggaggggttaaagg

SEQ ID NO: 261532 - DNA, 656 bp, Homo sapiens
ccaacgactatatgctaaggatgccaaatctgtatttccagctcaaatatctctcttgagatcctgcattatatatttaaaggctttctgggcatccccactcggaagacccacagataactctaacataagtacaaaactgagcctagattagctgggtgtgggggcgcacacctgtagtcccagctgctcgggaagctgaggtgggaggatggcttgagcccaggaggtcagactgcagtgagcctgagccgtaatcgtgccactgcactccagcctggatgacagagtgaaaccctgcacgcccccaaaaaaaccctgagcccagaatctgaacccgagtggaagggcattcccgttacataccaaggggggcatgaatacagggaggagtataattaaagtcattcttaaaaataacctaccacatttgcataaaccagaaattcattctgtggtgacaataattagtttttggcatgattataacactcagcccttgggtatttggccaaaagttatatttggtgcacctctaccaacgggcacagtaagtatcttataagctgtatcttttagctaagccagaaggctatggctcagacaagtttcttaggccacaaaactcaggtgttagaaacaagcaaacaaacaaa

SEQ ID NO: 261533 - DNA, 430 bp, Homo sapiens
atttttttcacctttctatattttactttcacaattataagtaaataaagacttgttttaacataaatcacactttatagtaataaagagcggatctctgttgctctccttttttactttaaaattttttatttttaattattatggagacataataggtgtacatatttatgggatacatgtgatgttttgatacaagcatataatgtgtaatgaccaaatcatggtagttggagtatccatcatcttaagcttttatcatttatttgtgttaggagcattccaattctaatcttttagttattttgaaatatacaataaattattgttaactatagtcactgtattgtgactatatagtgtttccatagaacactagatcttgttccttctatctaactgtctttttgtacccattaaccaactcctc

SEQ ID NO: 261534 - DNA, 680 bp, Homo sapiens
gccacattccccaaagcatttgcctaagaacatgagtcctgaaaggtgttattaggtagaacatgaaatatcaggataccttccaatattttggaaggtgatacctttctacattgcagcaattaccaaattcctgtagtctctaaatgaaaagcccccagaatgaaggggcagatttgtctgaagaattattcagatagcagtgcaagggagaagcaaaaataggaagacactgtgcctttgttgggtacaaggtatatcaattatatagcactgcataaatacacagagaacaagatttttcctctaaatcacaatcctggtcctcatagaatagaccctaaggaatatgcttatttaaaataagaaaatatcaattgaatgtaacttcaacaagagcaggaaggtcaggccaatcagtttataaggagtgaaacagtctaagagaccagatggcacagagacaggaagccagagagatgaagacaaaagttcgttggtaatatcagcaattctataggtatattttcgttgtctaaaacttattttttataaacacagccatttcacagtgtccacatattatttcttccttctgataaaaatctgtttaaaaaacagtcctacttttgaaaaatgttaggctatctttacagaacaaaataagactctctttgctt

SEQ ID NO: 261535 - DNA, 464 bp, Homo sapiens
atccgcagcatttaccacagacattttcctcagccttttaaaacatatgaaacacctgagaaatatttatgagcctcgtataatcatttttttaaagatctgaaatctctccttttagattaatacttaaacaattgatgaagataatctctcttatctgggcattacatttttcttctggtacttcaaagattaatcataatcatcctaaaattagtgactacgaatctttggcaggatggcccaacttccgttataaatatcatagacattttgcttttttatcccaccatgtttaagaaaaaaaaaaaagtatgtgtttatgtacagaattaaggagctaacaggccgggcatggtggctcacacctgtaatcccagcactttgggaggctaaggcgggcagatcacgaggtcaagagatcgagaccatcctgactaacacggagaaaccctgtctctact

SEQ ID NO: 261536 - DNA, 227 bp, Homo sapiens
ggaaataagtattctctgacagtaaactagactggaactcagggataggcaggatcatctccattacattctccagcactggccgggcgcagtggctcctgcctgtaattccagcactttgggaaggcgaggcaggagaatggcttgaggccaggagttcaggaccagcctggggaacatagggagaccccatctctacaaataaaaaaatttaggaattagtcggg

SEQ ID NO: 261537 - DNA, 659 bp, Homo sapiens
ttcatgatccacagaaaaataaaaaaacatggagccccagagcccaagcagagccaaacagacaagcaaccaaaataaaagttgaagttgtgggatctcatccaattcccaccagattgtatcctcacccctgtctgaccttattgttgctcacactctatgtcccaaaatgaaaacccaagacgatggagtattgcccccttatgatgtgaaccaactgcttggctgggacctgaatttgagtttattcctagggctctgtttgatgttacttctggctggctcatgtctgccctctcctgggatcacgggactatcccatggatccaacagagaagacaggtgaagttgctggaacccattctccattcagcagattgtatcctcaccccatgtgaccttattgctgctcagactctatgttccaggataaaatcccaagaagatggagaagtgcatccctcatgatgtgaagcatgtgcgcagctgggaaccaaattcgagagctcacagtttgaatagaagaatccaaagctacaacagcagcagcagctatagctgtgaccgctatgaggcccgtgatgacagctattaagggagactcaccaccaaggggattaccaccatcgtagctaccattagattactggtggtcagca

SEQ ID NO: 261538 - DNA, 425 bp, Homo sapiens
tgctttttaaaaagtaaagtttatttttttagagcacttttaagttcggagcaaaattgagagaaaggtacagagatttcctatatgttccctgcccccatccctgcagtttccctctttatcagcatccccccaagccccttcctctagtgcttccaaaaatacattaaaaactcctcttgctttatcatacagagaagtatttatcttttaaacctcaacatctcttatccagattaacacaaagaccttctctctccaaaaaaaaaaaaaaagctcatcaaagaggcttcccaaacagaacagttttcccaagagtaagaaaatagctacagtaagttttatttatttatttttaaaacagtaattttgcctttctgccccatgactatagcggtaatcatccacttgaatcctctgtagta

SEQ ID NO: 261539 - DNA, 448 bp, Homo sapiens
tcacttcaagccgtcctctccaccttccagactattcctatgggagatgattattagcccgtttttttccaatgttttgtctaaaaataaccaaaatttaacttttcctgagaattacatggacttctggaagtacttttcccactgcttttaagtgggctctcctccctttaacacccacccatttttttcatatgaactcttatttttttttttatcttaaaccttttcattcatagctttcaatctgcattttgaacctaataggaaatctctgttgggcttcagcactgtctgtatttaacaccatgtgtttctttctaggatttagatgttgtgcatgaaaaactatatagtgaatggttttataagttctaaagctaacagaaattactcttgtattttcctatatcaggaaataaagatggaggaagctatgacctacaca

SEQ ID NO: 261540 - DNA, 477 bp, Homo sapiens
atggaaaaagcattgaaaattgacacacctcagcaggggagcattcaggatatcaatcatcgggtgtgggttcttcaggaccagacgctcatagcagtcccgaggaaggaccgtatgtctccagtcactattgccttaatctcatgccgacatgtggagacccttgagaaagacagagggaaccccatctacctgggcctgaatggactcaatctctgcctgatgtgtgctaaagtcggggaccagcccacactgcagctgaaggaaaaggatataatggatttgtacaaccaacccgagcctgtgaagtcctttctcttctaccacagccagagtggcaggaactccaccttcgagtctgtggctttccctggctggttcatcgctgtcagctctgaaggaggctgtcctctcatccttacccaagaactggggaaagccaacactactgactttgggttaactatgctgttttaa

SEQ ID NO: 261541 - DNA, 484 bp, Homo sapiens
aaagctatattcatgctgacatgagggcacatgcttattttattatccatatgctgatatttttctgggaaacaaattattcacagaaagcacttgtaagacagaacccacatctgacattttctgtggtagagcagagtctctcctcaccatccctgctggcagggcatctggattaagtgcctgcagttttcctatacacaaaccgaggggttctggatcttttatactttctcttcaagggtggaaccaatgtttagaggtatctgctttctcttaactgtgctgaaaatccaatgtgttactctttaaaagagaaaagcccttatatgatacaattagagaagtgttacttccccttagcagcagtcccagttgatcaccaccttgaagtggaatttcctgatttttcttaatacctaataacaaacaactttattgaagaaataagaactttggttgtgtaatttttcagaaaaaaaaa

SEQ ID NO: 261542 - DNA, 541 bp, Homo sapiens
tttattcttgcaaacttttagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctattttgaaataaactattcttgaatccctcacagtaaaacttcaaa

SEQ ID NO: 261543 - DNA, 402 bp, Homo sapiens
caaaaatatgctacatcacaatttttaagaatgtcttgagctcagaacatgtctattctatactatcaagctgatcttttaagtagcacatagtagaattaaagcctaagtagattttgttattctaactgttttatcaacattttcagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctattttgaaataaactattcttgaatccctcacagtaaaacttcaaa

SEQ ID NO: 261544 - DNA, 669 bp, Homo sapiens
tttattcttgcaaacttttagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagtatgttcctgcagtggctcttggagcaaaagtcaacagtgtgagtctccacacgttgctctgtccatccaagttggagctgcacgttagccctgtctcctatctgccatcttcctctccacatctattcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctattttgaaataaactattcttgaatccctcacagtaaaacttcaaa

SEQ ID NO: 261545 - DNA, 425 bp, Homo sapiens
ggaaatgaaatgaaaaaagaaattgtattacttgaaactttgccatgtgcaagaaccctggaggtgatcgtgctctttcatccataaacttgatgtttatttagctgacagcaaagatagcataaataataggtaagtagtggacgaaatgttcccaactgttttttctccatcttttgtcatatttctagataatgccttctacagaacacttaatgttgaaacagtgaacaaaaagcaattttcccacaactgaggcatctctgttcttgatcagtaaatatcaaaattagtagatggcagaattgcatggagagaacagactgtcttgaagaaatatgtagaacaaattatgctagtacttggaaattttgcagcagacttgcaacactgtatcattgcttgttttctggatctatttagta

SEQ ID NO: 261546 - DNA, 2495 bp, Homo sapiens
  misc_feature (2420)..(2421): n is a, c, g, or t
  misc_feature (2461)..(2461): n is a, c, g, or t
  misc_feature (2495)..(2495): n is a, c, g, or t
acgcggggattctgtgtaattcctatccacagtcacttctgttcatttttaatgaaaacctattgctgttattttctattatgagttaacggtgatgtgtgttttttaaattttgtatacttgctctcaccctaaaatataccttaagagacttttcccctgtttttctttctgctttccaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatgatggtgtcttgctccacctccagtctgttgccaggctggtctcgaactcctggcctcaagtgatcctcctgcctctggctcccaaagtgctgaaatttcaggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcgttaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttccnntggatttgattaattttaatgaaaaacttaattctgactnctcaagccaattaaaatgaaaatggaatttattn

SEQ ID NO: 261547 - DNA, 1284 bp, Homo sapiens
  misc_feature (1209)..(1210): n is a, c, g, or t
  misc_feature (1250)..(1250): n is a, c, g, or t
  misc_feature (1284)..(1284): n is a, c, g, or t
tattttaccatttccataagcacaagaagagggtttctttgttacccctcatgaaagtttgtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcgttaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttccnntggatttgattaattttaatgaaaaacttaattctgactnctcaagccaattaaaatgaaaatggaatttattn

SEQ ID NO: 261548 - DNA, 402 bp, Homo sapiens
ggagatgagaacagaaatggaagttctgaagcagcaggtgagaagctggaagtggcatgatcctgtggagaacatactgcccatttttcatgcttctttgggcatttttagatgtcttgctgctagaaatatgtcaaaggtttttgcatttattttaagtagaattatctaattttcaagcttgatagaaagaatacagatcagctagttcagtcccaccatttagaacatagggaactgagtttcagacagattaaatgcttacccaagatcacacaattaaaagaggggcacgccaattaacctttgggtgaggttctattagcactggggctagggagtttcacgtagacatggtttttgtttttgtttttgagacagagtctcccattgtcactgagg

SEQ ID NO: 261549 - DNA, 2394 bp, Homo sapiens
  misc_feature (2319)..(2320): n is a, c, g, or t
  misc_feature (2360)..(2360): n is a, c, g, or t
  misc_feature (2394)..(2394): n is a, c, g, or t
acgcggggattctgtgtaattcctatccacagtcacttctgttcatttttaatgaaaacctattgctgttattttctattatgagttaacggtgatgtgtgttttttaaattttgtatacttgctctcaccctaaaatataccttaagagacttttcccctgtttttctttctgctttccaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcgttaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttccnntggatttgattaattttaatgaaaaacttaattctgactnctcaagccaattaaaatgaaaatggaatttattn

SEQ ID NO: 261550 - DNA, 288 bp, Homo sapiens
tggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagcag

SEQ ID NO: 261551 - DNA, 407 bp, Homo sapiens
caggccacctagcttcctgctgtcagaaagttctcattgctagtaagattttcttgacaatgtgtaaagtgctgcacctcccttgtgaataacgcctgggaagtggtgttagtgtcatggtttcccagtgcctttgaccttgtggattcctggtttcagtggcctctttcttcccactgggttgtgggaagaaaggcagacagccttgaggcagacagcctcggtgcattgttgaatgtaagaatgaataaattggtgcacaaagaccgcatgaaccctcaggatttctgagttcctatctctttagcctggtgctcggcactcatccagggtaattggtcaggcttggtgtactcaggaaaaggagacaccgttatctctccaataaagtctgtatctgatgacat

SEQ ID NO: 261552 - DNA, 466 bp, Homo sapiens
tgagcaagagcatgtgatctgcctaggtccggctctatgtggggaacaaaagtataagatgggggctctgtccccaaggaactgggtctaataggaagactaccaatggctgcaaagtaagtcagagatcaatgaagtgtggtaagtaattgaaagtgaaattgtgtggctctgaagcccgcatgagcggaatgtgaaaacagatcagctttgagtttcagctgtaacctcttttgctcccttacagatgggaaactgtgaagagcctccccaaagaaaatcaaatccacgtaattgttctgtctctcaaatgcttgtactcactccattcatctgagcccgggtctggtttatttcctcctgcacaatgtggggccctcctttacaggtaaaaatggcattttccaccctttgatgtttctccacagccccacaaagaaaccagaaaataaaactgtcaacaaca

SEQ ID NO: 261553 - DNA, 399 bp, Homo sapiens
agtgaaggaggaggaagaacaggagggccttttctgtccacagcacattttggaggattggtgttccatggaacactctttggaaagcatggccccccgctgttctgcaaagctgtgtgccttgcccttgttcattccagttgccctctgtttttccacttacttttcctaccctgagataacagtgatgcatctattgctacaaggaggattaggggatggggagaggctgttaagtccctctctaaccttttcctgctgttcaaagcatgaacaaagtgaacatcttatatggctgcactaaaaaagttgcccgcttacaagctgaactcaggcaaaatgaactcctgaatcctcacataaacggaaatagagccccaccctgtatcctgccattta

SEQ ID NO: 261554 - DNA, 652 bp, Homo sapiens
ggcagggtctccaagccactctcctcagcttgctggcatcctagccccagcctgtcggggttccctgctccctgcctggcatctatcttccatattccatcaacctgggttttttgtttgttggttggttttttttttgttttgttttttattttgagacggaatctcattctgttacccaagctggagtgcagtggagtgatctcggctcactgcaaccttcacctcttgggttcaagggattcttctgccttagcctcctgagtagctgggattacaggcatgtgccatcgcacccagctaacttttgtatttttagtagagacggtgtttcactatgttggccaggctggactcaaactcctaacctcaagtgatcctcctgcctcggcctcccaaagtgctaggattacaggcgtgagccaccacacctggcccatcaacctggttttgaactttctgcctgagccttgaacttgacccctctgggttgctaacctggggcatgtgtccccagacttcatgccagtcccttccccagacttcccccaggctacttagctggacccaaccctggcctagtcaggcccccactggctggggagagatagcaggcccagcacatgtggactatgagggttaatcgtaggca

SEQ ID NO: 261555 - DNA, 248 bp, Homo sapiens
cacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaa

SEQ ID NO: 261556 - DNA, 526 bp, Homo sapiens
attgcttgagtccaggagtttgagtctgcagtgagctatgatcatgccactgcactccagtctgggtgacagcaagaccctgtctcaagcaatttttttatattagtttatgtaatgtttattgaaatcacagtgtcaacaagcacctctggcatgaaatagtcacaggagcgaacacaactatctcttggaagcatgcagtttgactcatggaatcaagcatgtgctgtactataataacttgtctctccatgccgtaatgccatcctgactgagatttacctggcccttcaatatagcattttgcatatctacctatgacatgatgggaggtggctaatggggagggatgcgccctggggagttttgtgaatgtgttaagtggagttaagagacctactgcatgctattgtatagattatacattatatatttaaccatttgttgctgtacagtgaagctttttctagtatttcttttttgctattataaacaatgttgcagtaaatatcctaaatactctaaa

SEQ ID NO: 261557 - DNA, 537 bp, Homo sapiens
tgaacctggggaacatagcaagaccttgttactacaaaattttaaaaaattaggagacgtggtggcacacgcctgtaatcctagctacttgggaagctgaagtaggaagatgacttgggcccaggaatttcaggttacagagagctgtggtctggtcactgcactccagcctgggcaacaaagtgagaccctgtctctaaaaaacagaagttatattttaattggcaaataaaactatatatagttatggtatacaacatagtgttttgaaatatgtatacattgtagaatgactggatcaagctaattaacatatgcattacttcacatacttatcttttttgtggcgagtacaattaacatctactctcagtgaatttcaagaatagaatactttgttagtaactatagtcaaaatgttatacagtattctgttgctttcagttgtatcaatctcaacactcccattgcctcattcaaatatgctaaaacatttacatttctaaataaaccttggatgtttcattggtaaaagga

SEQ ID NO: 261558 - DNA, 471 bp, Homo sapiens
gaaaccgagggagggagagagacagcgatcgagagagacaggggagggcgagagggaaggagacagacagagaggctgagaaagagagaggcacagagaaagagagagagagagacagagagacagagggaaaacgacagaagtagcgcgaggtccagggggaaacccagaagagagaggcggagggagctagagagcgagagcgatagagccttagagaggaagcgcccggctccgttaggcagcgccctcttgagcaagccgggatagggtggagggggcttgggctgcgcccagaacacgggggccaggcggtccgtgcgagaggaccaacggagcgctgaggcgggcgtcttcttggatgaattgcttgctttggaggtgggtttcgtaggctcctgcctttcttggcacctccctgtgctctgggtgccttgcggcgggccccgagatttgcagagcgcgcccgcc

SEQ ID NO: 261559 - DNA, 665 bp, Homo sapiens
ggagaagcccacccagcaagaaactgaggatggccaccagccaatcaccagtgaggaactgaggccctcagccaaccatcctcaagaaattgaattctgccaacaatcacatgagcttgaaagtgtatccttccctagtagagccttcagatgagaccccagtcctggccaacactttgctgcctacgaacaattctgttagaggtcccaactaagccatgcctgattcctgacctacagaaagtatgagacaataagtgtgtaatagagacaactactgaatcagattctttgagggtagggcccagcaatctgtgttttaacaagcttttcaggtaattctgatgcaaactaaggtttgagaatcactgcattaaactttgggacaatcttcttgctctacttcctaaatgtcatcaaccatgcatatggtttcagggcaagagataaaaagattagagaaccattctctaaaaaatggattcttgggttatatgaatcacagggaagaataagtctcatatatctcttccactggcacccagacaaaaacatattgctctttagagattagcaatccaaaattctttattggaagaattgaaaacttatgtgtgtgtgtgtgtgtgtatatatatacatatgagagacagagaatatatttg

SEQ ID NO: 261560 - DNA, 482 bp, Homo sapiens
ataaagaagatgtaaagactttttcagcaaacaaaagctatgggatttcatgaataccagatgcattctacaagcaaacctaaagggagtacttcagtcagaaagaaaaaagtgttaaggaacaatcaacaatcacctgaaggtacaaaacttatggataaaaataagtatggaggaaaacacaggatataataacactctaactacagtgtgtaaactactgttatcctaagtggaaaaactaagcaataaaaaaaaagtaataatcacaacattttaggacacagtagagtaaaatataaatagaagtaacaagtaagaaaagttgggtggaagctgaagttaatctgagtttttattagttttctttttgcttgttagtttatgcaaatagtgatatcaggttgaaataatgggctataagatagcatttgcaagtctcatggtaacctcaaacaaaaaaatattttaaaaatgcaaaa

SEQ ID NO: 261561 - DNA, 528 bp, Homo sapiens
acagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 261562 - DNA, 753 bp, Homo sapiens
acagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 261563 - DNA, 169 bp, Homo sapiens
ttttccttctagtatcaatgcaaaattgatactagaggagaatgtcctgttagtgctatacattctctggcctggagactggtgtgaacagggttgacctgtcttactctggtaagaaagtaatcaggaagtaccctgagagctcttggcaagccgggttcactttttc

SEQ ID NO: 261564 - DNA, 295 bp, Homo sapiens
aaatgatgttggactatccacccacattgcaccagtgtcaaagtcttggttggaatactgtattataatcatgtaagatgtaacccctgagagaaactggatgaagggtgcagggggccactgtctttacaacttcctgtgaatctgtaattatttcaaaatataaagttaggaaaaaaagaaagcaacagctgtaagtccagcatggcatcctagattgtatcccaaagcagaaaaatgacattgttgggaaaaatggtaaaatccaaataaactctgtagttaatagtaaaaa

SEQ ID NO: 261565 - DNA, 328 bp, Homo sapiens
aatttactgcggccactgtccttgcatcgtcaatgcattgcagcaccaccaccagagccagcagcaaatcgcatctcagtaacactgtggagagtctttcacctcgtggacttcttgaaagggtctggggggaccctcggaagtgcacggaccatgctttgagaagcactgtgttggacacagtcggggatgctaggtaaatcagattcaattaattaagtctcaacccgtgggtagacagctttttaatattttgtgtaacaaaataaggagtctgtgtctagcacttctgctcctcctgcagtacaatgattacctcaaaaaaagg

SEQ ID NO: 261566 - DNA, 378 bp, Homo sapiens
ctacttcgggcggggctagggctcgggttacaccaaccaccacgagggcggggcagtggccgggaatagaaacttggcctagggccacaggggatttttggcttttgactctcttgtgaagcaatctccagctctttagtgctgttgcactctacagagtacatacattcagcgacataagccagtgcacagaacacagaaaggcagggtggaaaagcagttatgttgctgagctgcgagtcaggacgctagggctcaattcacagccgcatggctgtctcatgactcagaccactcacagtgtgtccacttctcccctcttctcgaactgcgaggtgctcatacacggtcaagaaattaaacaactcagccgggtgc

SEQ ID NO: 261567 - DNA, 376 bp, Homo sapiens
taagtgtaaatcatcacttgtggctcgtggctaccttactgggtagctctggctagctctacgggatctaggtcagccttcttaaaaagatggaagaggttgggtgtgatggctcacacctgtaatcccagcactttgggaggccgagacaggaggatcacgaggtcaggagttcgagaccagcctggccaacatggagaaaccctgtctctactaaaaatacaaaaatgagctgggcgtgatggtgggtgcctgtaatcccagttacttgggaggctgaggcagagaattgcttgaacccgggaggcagaggttgcagtgaaccgagattgcgccactgcactccagcctgatgacagagggagactccatctca

SEQ ID NO: 261568 - DNA, 690 bp, Homo sapiens
ctaatttcatgctttgcaaattcaagatcctattgttatgtagttgtgggggatacaggatgacagatgtttgcagaatttccatgtttccctaagaactagattttgcacatcagtaagtacgtgggagacaaggtgtaaactatgatacaactaaatacatagtagttacacttcatgaatataaagaaagtcatacaaaactacatttcttttagttttaagaaatactatagaagtgaattatcattttttaaaactcaacatctctttttagttaaatgtagagaactatgaagtcaatttatttgaattaaacattaaaaagggtattattctaagcagcaattaagacttaaatgtcataatttgatttctccctggaaagcagttgtttgccatcctatgagctgttaaattggccacatctggagagaaaccaaagacaatgctatatcaagcctcactttcagagggtacatctgcttcttgagaaaaatttaaaaaaagacaaccaaagaaatcaaagaaccacaacaaatatgtgagagtgggtgataaactcgttaccatggagagttgttggattaatttctatctcaccagtgtgtccctgtcatattattaatatgtaggtaaagagttccaaggagagaaataccatctcaggccacagctcccagcagtttt

SEQ ID NO: 261569 - DNA, 376 bp, Homo sapiens
agaattgcttgaacccggaaagtggaggttgcagtgagctgagatcgcaccattgcactccagcctaggcgacagatcaaggctccatctcaaaaaataaaaaaaagaaccaataatatttactgatggtaataactacagtgctacctaatgttgcactgtgtcattaattagatgactttatgtggctttaataggctgagggctgagattttattttggaaccatggagagttagacctgggctgttctgggaagcttgctaacttgggctgtgatgcaaattcatcttttttttttttttttttgagacggagtctcgctctgtcacccaggctggagtgcagcggcgcgatctcggctcactgcaagctcc

SEQ ID NO: 261570 - DNA, 510 bp, Homo sapiens
taccttgtatggtttgtggcaaggactaagtgagtgagatagcgtaaatgaagctcaatgcgtaggaattacttagtcattgggtttctttggacaagttacttcaacctctcagttaaagtaacctttcagttaaagagtttcagttgcctcatctattaaatagagatgattatacccttttccctgcctgtttttcaagactgtagtagtgaagccaggcatgatgactcaatcctgtaatcatagcacttcgagaggctcaggtgggaggatcacttgagcccaggagtttgagaccagcctgggaaacatagtgataccccatctttgcaaaaaaatttttaaaaaatcagctgagtgtggtgatgtgcacctgcagttctagctacttggaggctgaggtgggagggttgctggagcccaggagatggaggctgcagtgagctgtgatcacactgctgtacccccgcctggtgacagagtgagatcctgtctcaaaaaaaaaaa

SEQ ID NO: 261571 - DNA, 431 bp, Homo sapiens
tgattaatatttagaattaattgacaactacagagagccagtagtggtggtgctgataagaatgtggatggtaaccaaaacttagtctgtcttacagttttgcctacagctggtcatagtgaaaatatgtagtgtgaaagtgaatgtcattgatggacaagtcttctttaagacatttgacttcgttttctacttttgtccactccagattttttgccaaaacaatatggattttttttctttggcagaaataaaccccagctctctagctaccttgagcaaagaagggaagttattgatcgaatatcagtcaattcacagaatgatttggaagcctggaagaccagagttgcacaggaaccagggcaaccttgggtgatgaagcaacagaaactgctcatccttttgattgtgggatctccagtggatta

SEQ ID NO: 261572 - DNA, 714 bp, Homo sapiens
ctcacgtagttagaaactggcgaagctgattggatctaggcctgtgtgatcctgagcctacactcaggaccgttctgatcctgaccagtacttactgatttggggtctgagaagacagtaatgagcaagggcccccagagaagttttctgaccttcacaaagccctgctgagatcttgacctctgttcttaagaggtggatcttgcctcagttatgctcagccatttcattacacaggaagacctcattcttccttacattgcaatttattgttttttaaagaaactggccttgtattgtggaaataacattggaaaatggagattaaaatgggtaatggaaataacaatcagtaatggcttaagaacagaagcttgattggggaaaagtcttccgaatagaaagatgatcaagtgggaagaaaataaagtggaactttgagtttgaaatggctcactcatgcctgtaatcccagcactctgggaggccaaggcgggcggatcacgaggtcaggagttcgagaccagcctggccacactagtgaaaccccgtctctactaaaaattagctgtgtgtggtggtgtgcgcctatagccccagctatttgggaggctgaggcaggagaatcacttgaacccaggaggcggaggtggcagtgagctgagatcacgccactccactccagcctggatgacagagcgagactccgtctca

SEQ ID NO: 261573 - DNA, 374 bp, Homo sapiens
aatcaaaagggaactttaaaaaatgttttcaatgtattaggaacaaaataatgaaaaacaaaacaaacaaaaaaataaaatttaaatggcaaatttgacctctaatatataaataattacatgatatttagattgtctaaatatactaatcaaaagacagagatggtcaaagtggactaccttcattgctggtgggaatgcaaaatgatacaactactctggaaaatagtttagtggttttttgtttgtttgtttttgttttttttgtttgtttgttaagatccagcaaatgaacttctgggcattttcccagaaacatgattatttatgcccacaaaaataactgtatgtaaatgtttatagcacctttattt

SEQ ID NO: 261574 - DNA, 659 bp, Homo sapiens
gtgacttccctgggttcacagcaggggtggaactggattcttcctggatggggatccagatggaggtggagggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaa

SEQ ID NO: 261575 - DNA, 873 bp, Homo sapiens
gtgacttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaa

SEQ ID NO: 261576 - DNA, 1083 bp, Homo sapiens
gtgacttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggcgaggaaggggaaagcatcctctcatccctggcccagaagccctatcaaagtgaatggcccacccaagctctgactcctaccctgtcctcccctggcacaacccccaccccagcctgtaccatttctctatgaaacccctgttctcacccctcctccatcctcttccccaaaccagtgccctcctgtgatctccctgttggctttccaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaa

SEQ ID NO: 261577 - DNA, 1426 bp, Homo sapiens
  misc_feature (1425)..(1425): n is a, c, g, or t
gtgacttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggcgaggaaggggaaagcatcctctcatccctggcccagaagccctatcaaagttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaaaatccaaaaaaacaaaaaaacacaaaactaaacacaaaaaacctgtgtgttgcgcggcacctgacggccctctcgcagagagagcgctcttttgcaagaaaccacattcggtgtggggcgcggcgcgcggggcccccggtgcggcgtacgtggcgcacacctgtggcgcccaaaagccgggataccccaaaggagaaaacccccggggggacacaagagacaaagcgggcgagagagatctctcacccacagtataaaaaacaaagtcgcagccgcggggaggagacaaaccgacgaggagcggttctaggcagaagcacaagaactccccacacaaaatgagggagagcacaccacgagagggcgcagctcaactacgcagggcgagaaccactatcacacaaacccagcaggggagttaccaccaaagaggcggagcctccacgaagaaatactccagagaatataaaacgcccccccgaggcggctcgggaggggagnt

SEQ ID NO: 261578 - DNA, 924 bp, Homo sapiens
gtgacttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggcgaggaaggggaaagcatcctctcatccctggcccagaagccctatcaaagttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaa

SEQ ID NO: 261579 - DNA, 3068 bp, Homo sapiens
  misc_feature (1940)..(1940): n is a, c, g, or t
  misc_feature (2367)..(2367): n is a, c, g, or t
  misc_feature (2402)..(2402): n is a, c, g, or t
  misc_feature (2440)..(2440): n is a, c, g, or t
ccatctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatgggcacatgccccacactgcgggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatcnaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccaatgtctacacctaaggactcaaatccanaagcatgaagcaacagctaagcaagaactaatggntaaattatcaacttggaaaacttggaaaatctggatgncagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctcttaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgttagcactgcaaaaaaaaaa

SEQ ID NO: 261580 - DNA, 2765 bp, Homo sapiens
  misc_feature (1940)..(1940): n is a, c, g, or t
  misc_feature (2367)..(2367): n is a, c, g, or t
  misc_feature (2402)..(2402): n is a, c, g, or t
  misc_feature (2440)..(2440): n is a, c, g, or t
ccatctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatgggcacatgccccacactgcgggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatcnaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccaatgtctacacctaaggactcaaatccanaagcatgaagcaacagctaagcaagaactaatggntaaattatcaacttggaaaacttggaaaatctggatgncagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctcttaatgaaaacaaaacataaaaacatcacactaatcttggaggaataagaaaaattgtacatccattaaatgtacaattgattgcaacatcttgattg

SEQ ID NO: 261581 - DNA, 2070 bp, Homo sapiens
ccatctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatgggcacatgccccacactgcgggagcagtgcacagagctgtggggaccaggtaggaggacaaatcctttcccctgtgcatgtgcgaaggaaaatcatttcagatgacagtgtttaaccatggtcaaaagaccattctgtcctatccttcttagaagcttcgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgcaggggtggcagaagtactgtgggatgggacagaaat

SEQ ID NO: 261582 - DNA, 508 bp, Homo sapiens
atctagacgatccctgaatatgctgtctcagtataattccactggaaatgagataccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttcacaggtacaatgaggaaatcagatgagatcagaaaacgaggctatttgagacagcataatccgggaacccgagctcgaaattcgtac

SEQ ID NO: 261583 - DNA, 522 bp, Homo sapiens
tcactctgacattcatcacttcaggcttctgtgtgtggcatcgttcattgggaatgcagtaaggatggcctttactgaccagcctacttcagttctacctggataagtcttttctttttcttttttctcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggtataacggagtctcttcaattctttaattagggttttacccacagacctaaaggtagtgtccttgccaggcaaataatagaagtgaaactgcatttgtaacattagtgcttttttcagcagtagccatta

SEQ ID NO: 261584 - DNA, 2355 bp, Homo sapiens
  misc_feature (1227)..(1227): n is a, c, g, or t
  misc_feature (1654)..(1654): n is a, c, g, or t
  misc_feature (1689)..(1689): n is a, c, g, or t
  misc_feature (1727)..(1727): n is a, c, g, or t
aggaagagagatgtagaggcaagttgcttttaaccaggattggagttttgtcagctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatgggcacatgccccacactgcgggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatcnaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccaatgtctacacctaaggactcaaatccanaagcatgaagcaacagctaagcaagaactaatggntaaattatcaacttggaaaacttggaaaatctggatgncagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctcttaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgttagcactgcaaaaaaaaaa

SEQ ID NO: 261585 - DNA, 966 bp, Homo sapiens
catcgtcacccatttaaaaaaattgcgttttcaaaatgagttgcttcaacctagtgtggagaatcaaaattttaaaagatcaaaattttggtattttaaaagtcaattctgaccaattatagtgatttggttctacctgatagtttaatatttctttgctcttttagtaagtccccagcatagggggaagggggtaggcagtaagtcttagaaaactgtcttgcgaatttactgactcttatggattgggaatttctaggagtatctggaaattaaccgaagcagttctttttcttctccagttagggcaagttgccatgaaacaaataatggtgacttggttggttcatttagttcatttatttattgaatatttatggcctgtccactaattacctggcacaagtgtaggtcctagaagatacacactagggaaaaaatagacacacagactagatccctactgtcctgtcttacattctaggaggcggagagaaaatgttaaaaatgaacaaagtaagttgtcaggtcaggtgctaccaagtgctagggaaggagattagagtggtgggtgccatctggatagggtggtgaggggagccccatctgctaaggtggcatttgagaggagacttgaggtgagagactgggaagtgaggtggggaccgaagcctgacggactagccatgggcaaaccaggcaggagtttagccaaggtgaggacttgtagaggagttgggcagggatgtgaaataattagcttgatgttctgcataggatgccctgggctgcaaggtgtggaactgataagccaagacctcccaggaggctttgccgccatctgcagaatcatgctgatggctttgaagagagaggcagtggtggagagaagtggctgatttggggcatgttttgaataaagagcccacagatttgctgaagacttgactgcagggtgagagggga

SEQ ID NO: 261586 - DNA, 237 bp, Homo sapiens
tcgccgtgttagccaggatggtctcgatctcctgacctagtgatccgcccacctcggcctcccaaagtgttgggattacaggcatgagccaccatgtccggctactcagggaactcttaaaggtgacagtagcttattccaaaggaatgactctttgagggtggaatttggggtagcatgttttcctagagggagagtgtcatctgatcaaggagctcagggacacttatgcatcac

SEQ ID NO: 261587 - DNA, 485 bp, Homo sapiens
tgaaagatgaaaaatattgtcctgggtccctcagagtacacaccaggagttcccaattttgtccattccacaacgcctcaattctaaatgtaattatttggccaaatagggtagaagagggctccattaacccaaactgctactccaggcctggacatcccatgaggacaggtagcatgacattttgtactctactgtctctagcctctggtaaagtgcctggaacatgatagttgctcaacaaatatgtgttgaatagatggacagatggaggtgatgctgctgacaagcgaccacatacatcttaggaggaggataagaatgaagaacatcgcagttagaagggactctgaagtattgcaagaccagcctcttatgtttagattaggaaatgagggccaagttcacatgatggagtagaaagagcactgaaccagagtttgggagacctggaagcctcaactctgacaaaaaaacaaaacaaa

SEQ ID NO: 261588 - DNA, 443 bp, Homo sapiens
tctcaataaaaataaaaaaatcaaacgggaaggtattgatggtaaactcactaaccaaagtccttgtttaagggggcattaacaatggtagttttatcagaggcctgtgtggaaggcaacactaccagagaggaatttatagtggaagaatgaacagacaccatcgttaaaagtcagacacggacattgatgttaggagagttaatacacagagttcaataatagacaagaaaagcactgatgatagaataaagacacccagatttgaggtcaagtaagaggggcaaggagttttaattagttctgctttaattattctgttaaatatatagacaaagaggtgggatttgatattgggatagttagaaaatgcttgaactcagactagaggaacattccaggcgtaatagttaacacagaccttggtttaggatcaaaccaga

SEQ ID NO: 261589 - DNA, 4567 bp, Homo sapiens
  misc_feature (3147)..(3147): n is a, c, g, or t
  misc_feature (3197)..(3197): n is a, c, g, or t
  misc_feature (3839)..(3839): n is a, c, g, or t
  misc_feature (3921)..(3921): n is a, c, g, or t
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctntcatggttatcttccaacccactgtcacgctgacactatgctgccatgcctgggctgtggacctactgggcatttgaggaantggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261590 - DNA, 453 bp, Homo sapiens
agtaatcagctcggtaccggcatgtgctgtagccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261591 - DNA, 4675 bp, Homo sapiens
  misc_feature (3255)..(3255): n is a, c, g, or t
  misc_feature (3305)..(3305): n is a, c, g, or t
  misc_feature (3947)..(3947): n is a, c, g, or t
  misc_feature (4029)..(4029): n is a, c, g, or t
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggcaggaagccaagtggagactttgaatggaggcaaggatggaggggacctggggaagaggactggcctgaatcaccttccccaaaggtcctcatggactgagctggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctntcatggttatcttccaacccactgtcacgctgacactatgctgccatgcctgggctgtggacctactgggcatttgaggaantggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261592 - DNA, 4731 bp, Homo sapiens
  misc_feature (3311)..(3311): n is a, c, g, or t
  misc_feature (3361)..(3361): n is a, c, g, or t
  misc_feature (4003)..(4003): n is a, c, g, or t
  misc_feature (4085)..(4085): n is a, c, g, or t
attggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacgggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctntcatggttatcttccaacccactgtcacgctgacactatgctgccatgcctgggctgtggacctactgggcatttgaggaantggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261593 - DNA, 4703 bp, Homo sapiens
  misc_feature (3283)..(3283): n is a, c, g, or t
  misc_feature (3333)..(3333): n is a, c, g, or t
  misc_feature (3975)..(3975): n is a, c, g, or t
  misc_feature (4057)..(4057): n is a, c, g, or t
gcggccgccccattcccagaccggccgccagcccatctggttagctcccgccgctccgcgccgcccgggagtcgggagccgcggggaaccgggcacctgcacccgcctctgggagccagcttgggtccgggttgcactgggccctgccagggctgtggtcggcgcatctgggctgcagcggcgatggggacccgggacccaggcctggagaaggagacggacgagtgaggctgagggacggagggacagagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctntcatggttatcttccaacccactgtcacgctgacactatgctgccatgcctgggctgtggacctactgggcatttgaggaantggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261594 - DNA, 4405 bp, Homo sapiens
  misc_feature (2985)..(2985): n is a, c, g, or t
  misc_feature (3035)..(3035): n is a, c, g, or t
  misc_feature (3677)..(3677): n is a, c, g, or t
  misc_feature (3759)..(3759): n is a, c, g, or t
gcggccgccccattcccagaccggccgccagcccatctggttagctcccgccgctccgcgccgcccgggagtcgggagccgcggggaaccgggcacctgcacccgcctctgggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctntcatggttatcttccaacccactgtcacgctgacactatgctgccatgcctgggctgtggacctactgggcatttgaggaantggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261595 - DNA, 3938 bp, Homo sapiens
  misc_feature (3147)..(3147): n is a, c, g, or t
  misc_feature (3197)..(3197): n is a, c, g, or t
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcntgtgctggaaacagcagccagagccgcccctgcccctacagcgagattcncgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtcaaaaaaaaact

SEQ ID NO: 261596 - DNA, 514 bp, Homo sapiens
cagtcctaatgctttatagttaaatgtcatatgcagatatgttcaggctctaacatataaagttcctaacttgacaggaaactactgaagattgtgtacagcttaaaaaaaaaaatagggtaactatagtcttgatttttatgtataaattctatcattctatattttaccatcagacatatttctactcctttctttgaagtatgcgaagtatctccaactgcagcatgcaactcattcatttgtaatcaagacgatagtttgaaacacccaattgtaatcagagcaacagttgacttccttttgatagcggagttgaaaatcattgcaattaataaaatggggctattagaaatggaaaacgaataggatctagaatgtaacttcatcatataaatgatgagtgtctttgttatcaacacgttattaagaatgggcaagatgtccttatatactagaagcttttgtaaagtcatgtgtctattgataataaagattttcggaactgaaattc

SEQ ID NO: 261597 - DNA, 724 bp, Homo sapiens
gatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataa

SEQ ID NO: 261598 - DNA, 462 bp, Homo sapiens
  misc_feature (459)..(459): n is a, c, g, or t
gcaatgagcagagattgcaccattgtactccagcctgggtgacagagtgagactctgtctccaaaaatttattaaaaaaaaaaaaatcattacaatatattgtgaactttattactctcccaaataagggttttagtatactgtttgcggaatgtagttcaggcttttaattttcccaaatctataccttgggtgaaagtggtttttgagagaaactgaacacgcttagccagtagctggtctttgtacctaaaacagcagagaagagagtttggttgttctgggccttttccagcagcagaccctgagtgtttttttgttattgttgttggggggcagggacagagtctggctttgttgcccaggctggagcagaggttgcaatgagcagagattgcaccattgtactccagcctgggtgacagagtgagactctgtctccaaaaatttattaaaaanaaa

SEQ ID NO: 261599 - DNA, 523 bp, Homo sapiens
ttgtatctctctgctgtgttcaaagaaattgcatttagtgtataattgatttcatgatattactagaatggtcatttttacatttgttaatatatatgttacatgtgtagacaattaaatcattaactcctaacacagtaagctaaacttctcaattgagtaattcagtgatacatttaacatatgtggtctttggctacaatgcttatacaaaagatatagtaaggaaactgtgttataaaggacatgaatttgaaaaggacaagaaaaatttatttagagcactgactttcacacttgttttacctcaatccgtagtaagatatatttttcctaaggttaaaaagtatattattttaaatatgtattttacagtgtagcccaaccctcacatgtgtatgtaatgtgtatatgtttatatacatgtatattcacatgtcaatatatgtctatatattacatattatatttgatatatatttaaacatttgtttaatatatgtaattaaacaaaaatgttcac

SEQ ID NO: 261600 - DNA, 102 bp, Homo sapiens
ggggtaccattggtctaatgaggggtgccattggtctaaaaagtaaaagcaaactgtttctatttgtcattacatattaatatggaggggaaaaaagcattt

SEQ ID NO: 261601 - DNA, 302 bp, Homo sapiens
aagcactcccactttttcaaattagcatactgacgtgatgaagtgaaagtctgaacaagggcaggaagatgtggaggagaggggccaggaggggacagccatccctgggcactggaccgaggaccctgtgcagacagggaggtctccatctgggggcgggcagaaggagcagctcagctggtattcatgtgtgttttaattagcagacacaagtggttttgcttttactgaggtgtctgtgggctctcagagtacttactgtgcagtgaacttagacagaatgccaaactggatctctgaca

SEQ ID NO: 261602 - DNA, 204 bp, Homo sapiens
acaaagcatttatcaacagtggtttcagaaaagctgacttcctttcttccagtaattgatatggcagtgctattaattttatttgtttgtttgttaaatgcagcctgttctactgaatggtttgtgttgttttatttctggaatctcaaccttatctgttcccccagataactgctattctggtagctattaagatctttttat

SEQ ID NO: 261603 - DNA, 367 bp, Homo sapiens
gtactgttgtaattgaagaggcagtgttatattgttactgttatcctttttgttgggggaagaggaaatatttggatgactgattccctgtagaaccatcaagaggaggtgaagtgagcaaaggccaagtaatttatggactggtcataaattattttttgccattggctatttgtcaccattggctgttaccaaagggtatttatcaccttggctacccaattcgttgagaactctatagatacctagaagtctaccctgcatcttactactttgagatgaccacttaagattcttaagttttttctgttattcacccccatgtttccctccctccctccattcccccctccgtccgttccccctt

SEQ ID NO: 261604 - DNA, 157 bp, Homo sapiens
tgcattctcaacatgatgtgttagcaaataagcaaaaactaactgcagtgggttcacaagttagtttaattaaaatgatctttcaatattttaataatttggggactttaggaggttgaggaatgagagaacttcaccttctgtatattaactggtc

SEQ ID NO: 261605 - DNA, 343 bp, Homo sapiens
cattttacaatcccaccagcaatacatgagagatctattttttctgcattcttgctagtatttggtatcgttgctattaaaaattccttaactcttctaatagatgtatgctgatatttcatcagggtcttaatttgcattgcttaatgactaatgacattgaacatcttctcatgtgcttatttgccttctgtatagcttgtttagtgaaatgcctcttcacgtcttttgattattttctgattggatgatttgtgttttttagaagttgaatgttaaaagatctataaatcctaaatatgagtcaattgtcagatacattgtttgcggatagtttctccca

SEQ ID NO: 261606 - DNA, 519 bp, Homo sapiens
ctcttaacaatctacactgaggggagacctcagattgtgataataccatggtcacacagtactcattggggctatttattccctagatataccaacttcattgagtagtatgaatcttttaactacaagagtttgaagctcagttattcacattattaaacaaatgagccttgctttttaatagagcatgtgtgtttagctatagaagacagtgaaataaagagatacaaaagaacacacttttgaaaggtcaggaaactagataatagttcctgacataaaatttcttagagtagcaaagaagagatttggtcacaaaattggaaaaagtgccaaatttctatttgtaaccatttatttttatagcaactagtgacttgcttagatcattcgtctacataatgatagtactagatcccaacattatatttattattactacatttgtttatagtcttggtaggaatcagatgaaatggctgtgtcagaatatgaaaataaatttgattctagatcaaa

SEQ ID NO: 261607 - DNA, 472 bp, Homo sapiens
gagccactgacactgaccatccccatccccaatctaacttcttatctttaattttggcttccttctgcttcctattcccttatttttttcccatcctgcagacagctcatcaaatgtgcctttaaaacagtgccttaaaacagtttaaaactactcattcccaactggagtagctgaacagtagtcacctccacccagtcctcagaatgggcactgaccccaatgcactcacctccagcatggagtgtgttcaagtgcatgatgagagagtattgacaaggcataaaccaaggattgtgggtgctgtgtacatatgtaatatatatttaagatttaagctaattatattgcatcaaaccattctgattcagatttaggaacaaaattcacaaggctaaattccttttctaaacataaggatttcattgcacttcacagacttgcattctttttcttccaatagaactgaaaa

SEQ ID NO: 261608 - DNA, 539 bp, Homo sapiens
tgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagcagggttatcacaccacattgtaatatttaatattgacatccctactggactgcaagcctaatagaacttgggccataccgctcaagtttacaattgcatgctttttgcttagcactgtgtctagcacacaggaaatgcttaatatgtatgcgttgtttatgttatccatgccttaatgtttgggatgctccagatggcttaataaagtgtttaactatctttacaacctcaac

SEQ ID NO: 261609 - DNA, 257 bp, Homo sapiens
ttgaaggtcttcagagcttttaaaacgcttaataattataccctttgcctccacaagatggagtaagtaaatagtaaatgttaacttaaaattgcagtttactttttatattaaatgtctttgcctgaaaatctgcaccattgataattgtttatatattagaacttacaaacaactatgaaaattcacacagcttccctctgtgtcagaaagatgatttttctcattttaaacgggaaatacacacttctggttaa

SEQ ID NO: 261610 - DNA, 761 bp, Homo sapiens
  misc_feature (362)..(362): n is a, c, g, or t
aaaagctaagagtgctgatctcatcacagacatagccagctcttcagttcagaccacctggaaaccctccccatgtcttttcagaacaatgtcctaagaaccataggggaagtggccataaaaaccatctttcctttgcagactggggtggggactctggccaatgccattctgttcttccataatatctttcccatcttgactgagcatcaaatgaggcccacacacaagattctcacccacatggccgtggcaaactccttggttcttctttccactggaatcccccacacaatggtgtcttttgtcctatggaaacccttgtccagtcttgagtgtaaactcgtgtttacaggtcttanagtcctgacctggtgatccgcccgcgtggacctcccaaggtgctggaattacaggcgtgagccaccactcctggcctatgccagcattctttaaagttgggccgtttgttgatttcttcctgcaggttaagcaccgcaatgggcagtcaattgcagtgtatataagactcagaatccgtctttgcccttcaaggatttttcacgtatcataaacaacagttacagatgaaatgtttttgcaaagtgctttcataattttcattttgtttgtaatttcataattttcattttgttaatgttgcaatggagaagttaagaggcaaattattaattaaaaatgggcctctaataagttggaacaatgcaactttaaaccaattaataaaaaatgtcatggaa

SEQ ID NO: 261611 - DNA, 760 bp, Homo sapiens
ctcatcctgtcgtatgatacacactttcaacttgactgatcactgctcacactggccttgatcacctggctgagacagtgtttgttaggtttctccaacgtgaagttactctttttcctcctttgctatactgagttcttggtaggatgtcattatgtgaagcccacagtttagaagtggggagtgatgctctgcttcctggagtgtctgatctccttttgaaatgatttttcatgctgaacacagagtaattaaagtaagaaaaatacggatattgaatgactagttgcaagaagtccattatgacatctgacatgaaaaattatctatctacctgtctattaaacgattatatctgtgtatacaaacattaaatactaagctatgcagtatcgtctttactgaaggtaaaggtcattagattatatgccatgcagtgaactgagaaatatctcatttttcagacctaaatcccatcatttcttcagaataccaactctttatagaatgttgttttgggagaagtttatattggtgaaagtttactttgacatatctatgggataagacgactttctccacttcatagattttgaattcaggataagactttctctaccaatgagcaaaaatggaccaaaatatggggtaacacgaggaaatcaaatctgagacggtccacaactgatgcctttccttcaccatacttaggtaaatgctgtggcacgagttgttcacattaaacacaacgaagcaaatc

SEQ ID NO: 261612 - DNA, 315 bp, Homo sapiens
ttttaaatgtgtgcattattttataatcttttaagaaggccagggatggttctcttcagttttggaaggttaaaaatcgtctccttttaaagatactattcattaaacacactctcttggtttagagtattcattatacctagtaatcaaaatatatatagcacagtagaggctgtctgtgtacatgtcgtagaaacccaaataagtctccagaatgattttatgaataatctgccttcagttttaaaataaacttaaaaaaaaacttaaaacttggcatcatcctgggtggtactgtggttttcttcttctacc

SEQ ID NO: 261613 - DNA, 287 bp, Homo sapiens
caggatttttatctatttctgtaaaatatgccaatgaaatattgataagggttacattcattctgtaggtagctttgggtagtatggatattttaacaatattatttcttgcaactcatgaacacaggatgccttttcagttatttgtatgaatttcctgttgtacaagatgagtcagttctagaaatcatctctacaacatagtacatataattaacaatatgactttgtgcactttgaagtatgttgaagatagatctcatatctcatgttaaatattctcacca

SEQ ID NO: 261614 - DNA, 618 bp, Homo sapiens
cttcaaagaagagagggtttgaagagtggagaccatctctttctccccatcggaatctccattctatgaagggtatacacaagcctagggccatttgcaattgaaaatacgaacaagcaggccttgaccccagtatcaaggatacgttcatctaaatgttttctgccccttcctaaccctagaatcactttgttcctgataatggagaggacatggagcaaatgtagatgtgtgggagataaagaagtaggattaggtgtgactctcctgctagtccagggttgcagctctgttcctgatcctcccttggtgagaccgtaaccctgtgggttcaaggacgctgcctcagttaccactcctgccccaggagcgtggcataacacacgcttgttaaacactgatcagtgggctcagcaggtgcagtggaaatccacctggttgtcagagctccgtggctaacacctcacctctggactttcggctatttctttctctgtagtgttatctaataaaccttccagttaatttacgatccacatgaaaagggcctgtgatatgcaaggtgctcatttaacatgtgttaaatgggtcagcactggctgagccatgttcgtgtat

SEQ ID NO: 261615 - DNA, 686 bp, Homo sapiens
tatttcttttctttattaaaggctttacttttacaaatgaatacaaacaaaactataaaaccaacaaaatttaaattaatatgatttgctgaatgacatccaaacccacaatgtgaactgcatactgactgccaaggcaatgcttcttttgaggcccaagatttaaaaaacaaaaataaaagcatggaataacatggactagtgaaggagaaaatgaacactgattgatagtcacaataacagtgcacacttctagaagtcttttcatgaagaagtcttctcatgaagaagtctaaattttctcagcaatggtagaagaaatatcacaaaatccaggcacaaagctcacagcaaagcccctttggctcttgactttagattaggtatgattctagtcatcacaaggtaggtaagaatctggtaaacaacatggctgagttgctaagaggaaagcacactaacaagggagataatatgtgaagtggatacaactcaggaaagcttgtcaatctaaactatagccttatgcatagcaataggttccaaggacataaatatgttacagcagagtacaactagcatggtactgaaatgagtgtgcctagaatcctcttctgaaaagttaacggaatggccagtgttttttgaaagcattccatcaaaattaaaatacattaaaaaaaata

SEQ ID NO: 261616 - DNA, 667 bp, Homo sapiens
aaacaggaaggaggaaagcagcagctgcgtcagtggttgttgggagggccaaaggagcccacggctttgaaagctctttgtaaacaaagtactttatgcttttaactttttgtttactttcagtcagtcaaatgaagtgataattttttttttgtttactcttgagagactctaaagcaatgattctcaccctgcagcgtgcttaaaaattaccaggctggtcgggtgcattggctcacacctataatctcggcactttgggaggctgagcaggcggatcacctgaggtcaggagtttgagaccagcctgaccaacacggtgaaaccctgtctctactaaaaatacaaaaattggccgggtgtggtggtgcgcgcttgtaatcccagctactcgggagactgaggcaggagaatcgcttgaactcaggaggcagaggttgcagtgagctgaggccgcgccactgcactccagcctgggcaacaagagcgagactctgtctcgaaaaaaaaaatcaccaggctggcttacaaaggatggtgttttcactgcccttccactccaatccttcgcccacgccatctccaaccccacaccccttaaccagatcactggcctcccgccccccgcctccgcccactcctcgccccacctcccgccccgcttccc

SEQ ID NO: 261617 - DNA, 953 bp, Homo sapiens
aaaaaaaaaaaaagataaaactacaagataccatgatgatgaatgtcaggttttgtggttgggaccaaccatgagacaaagcttacgaaaaggtttaccctggcttagtccgcattaacagaaatatggtatctggagcatccagatccaaacctgctctaatctacgtgtctaaaggataagttggttcctagatgccttgccttaaagagtggggtgcttccccttgagcaaaaaagactatggagtgggccaggtgcggtggctcacgcctgtaatcccaacactttgggatgccaaggtgggtggattgcttgaggtcaggagttcaagaccagcctggccaacatggtgaaaccccatctctactaaaaatacaaaaattagccgggcatagtggtgtgtgcctgtaatcccagctacttgggaggctgaggcaggagaatcgcctgaacccgggaggcagaggggttgcggtgagccgagatcgcaccactgcactccagcctgggtgacagagccagactccatcgtaaaaaaaaaaaaaaaaaagctggagtgtaagaatgaactctctcttcaaaaatatgaagagcttttacacatgaaagagatgagatgttctgttgagacttaatggagcaaactaagaccccgagtagaagtcacaggaagcccaaagccccctcggcacaaggataaatatgtccgaagactgtctgaggagatggtaagttccccgactggggcacatgaggcaatcacagctaacgttttgaggatacctgttctatgcaagctgttttattgaatggattacaaaaagtatgttaagtaatgcacaccctaggaaggcgttccttgtaaaatgggcccatgtttcaggtgaggaaactgaagctcagagcgggagacagcttgctcaagcagaggccaaggcctttacgtcatgg

SEQ ID NO: 261618 - DNA, 1828 bp, Homo sapiens
aaaaaaaaaaaaagataaaactacaagataccatgatgatgaatgtcaggttttgtggttgggaccaaccatgagacaaagcttacgaaaaggtttaccctggcttagtccgcattaacagaaatatggtatctggagcatccagatccaaacctgctctaatctacgtgtctaaaggataagttggttcctagatgccttgccttaaagagtggggtgcttccccttgagcaaaaaagactatggagtgggccaggtgcggctggtctcgaactcctgccctcaggtgatccacccgccttggtctcccaaagtgctggggttacaggtgtgaggcactgcacccggccaaaaaaaaaatggtttttaattaaaaaaaaaaaagatacaggctgggcatggtggttgacgcctgtagtcccagctacttgggaggctgaggcaggagaatcacttgaacccaggagccagaggttgcagtgagccgagatcgcgccactgcactccagcctgggcaaaaagagcgaaactccatctcaaaaagaaaaaaagttaaattctctccatcatcatgaagttgaatatattttttctatccacaggcaaatctgagtagcctccaagaggcacacaagcagaggatgggctgtgttgccctgactgccagccccaggcacagaggaccaggcctggtcatcctcacagactctgaccctggctcttcccactcctcttccactccaggacatcctacttaacccctcctgacatgagtttcttgtgctttagtctacaggttaggaaagaggggaagtgataaacaagctctccaacctgttgagggattaggggttcgtctaaggctccccagggcctggctctgacaaagcgtctgcaactaatgatgcttcttgagctctggagacaggatttatgcatctaataaagtctgtaactccaggcttaggggccgggggcaggaggctgagagcatgaagtcctgggggcgccatgggaggagatcccaggtggctcctaatgagccctgcatttccatttgcctgctctagattcccctaaggctactgtgaggctgggggtgggggaacagcaggtataagaggttggggtggctgtaggagggtaggtggcagcatggattctaggcaggctgctgcactgctggtgctgctgctgttaatagacgggggctgtgctgaagggccaggaggccagcaggaagaccagctctccgcggtgagtgtgtgtcccatccccatatcaccattgcctctacttcggttgagacttgtgctctaggttctgatactttctctggctgccaaggttgtcattaggtcctcacatctgaggaaatggttccgcagcctcctaccacttgcccctggaagccagtcccttccccttgtgacttacgtgtccagggtatttgcccatcttccttccctgatacccccttggcacaggaggaagacagcgaacccctcccaccacaggatgcccagacctctgggtcactgttgcactacctgctccaggcaatggagagacctggccggagccaagccttcctgtttcagccccagaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttctgaaaaaatgtgtgtct

SEQ ID NO: 261619 - DNA, 1804 bp, Homo sapiens
gattctaggctactctatatgagagccagggccaggcagaggctgtggagaccagagtcggggtcagaatgatagtccagccccacagtagcctgctcctgtccttctgggactccctggagactggaccctagcacctccactcagcctcctgagtagctgggattacaggtgcctaccaccacgcccagctaattttcgtatttttagtagacagggtttcaccatgttggccaggctggtctcgaactcctgccctcaggtgatccacccgccttggtctcccaaagtgctggggttacaggtgtgaggcactgcacccggccaaaaaaaaaatggtttttaattaaaaaaaaaaaagatacaggctgggcatggtggttgacgcctgtagtcccagctacttgggaggctgaggcaggagaatcacttgaacccaggagccagaggttgcagtgagccgagatcgcgccactgcactccagcctgggcaaaaagagcgaaactccatctcaaaaagaaaaaaagttaaattctctccatcatcatgaagttgaatatattttttctatccacaggcaaatctgagtagcctccaagaggcacacaagcagaggatgggctgtgttgccctgactgccagccccaggcacagaggaccaggcctggtcatcctcacagactctgaccctggctcttcccactcctcttccactccaggacatcctacttaacccctcctgacatgagtttcttgtgctttagtctacaggttaggaaagaggggaagtgataaacaagctctccaacctgttgagggattaggggttcgtctaaggctccccagggcctggctctgacaaagcgtctgcaactaatgatgcttcttgagctctggagacaggatttatgcatctaataaagtctgtaactccaggcttaggggccgggggcaggaggctgagagcatgaagtcctgggggcgccatgggaggagatcccaggtggctcctaatgagccctgcatttccatttgcctgctctagattcccctaaggctactgtgaggctgggggtgggggaacagcaggtataagaggttggggtggctgtaggagggtaggtggcagcatggattctaggcaggctgctgcactgctggtgctgctgctgttaatagacgggggctgtgctgaagggccaggaggccagcaggaagaccagctctccgcggtgagtgtgtgtcccatccccatatcaccattgcctctacttcggttgagacttgtgctctaggttctgatactttctctggctgccaaggttgtcattaggtcctcacatctgaggaaatggttccgcagcctcctaccacttgcccctggaagccagtcccttccccttgtgacttacgtgtccagggtatttgcccatcttccttccctgatacccccttggcacaggaggaagacagcgaacccctcccaccacaggatgcccagacctctgggtcactgttgcactacctgctccaggcaatggagagacctggccggagccaagccttcctgtttcagccccagaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttctgaaaaaatgtgtgtct

SEQ ID NO: 261620 - DNA, 1598 bp, Homo sapiens
aaaaaaaaaaaaagataaaactacaagataccatgatgatgaatgtcaggttttgtggttgggaccaaccatgagacaaagcttacgaaaaggtttaccctggcttagtccgcattaacagaaatatggtatctggagcatccagatccaaacctgctctaatctacgtgtctaaaggataagttggttcctagatgccttgccttaaagagtggggtgcttccccttgagcaaaaaagactatggagtgggccaggtgcggctggtctcgaactcctgccctcaggtgatccacccgccttggtctcccaaagtgctggggttacaggtgtgaggcactgcacccggccaaaaaaaaaatggtttttaattaaaaaaaaaaaagatacaggctgggcatggtggttgacgcctgtagtcccagctacttgggaggctgaggcaggagaatcacttgaacccaggagccagaggttgcagtgagccgagatcgcgccactgcactccagcctgggcaaaaagagcgaaactccatctcaaaaagaaaaaaagttaaattctctccatcatcatgaagttgaatatattttttctatccacaggcaaatctgagtagcctccaagaggcacacaagcagaggatgggctgtgttgccctgactgccagccccaggcacagaggaccaggcctggtcatcctcacagactctgaccctggctcttcccactcctcttccactccaggacatcctacttaacccctcctgacatgagtttcttgtgctttagtctacaggttaggaaagaggggaagtgataaacaagctctccaacctgttgagggattaggggttcgtctaaggctccccagggcctggctctgacaaagcgtctgcaactaatgatgcttcttgagctctggagacaggatttatgcatctaataaagtctgtaactccaggcttaggggccgggggcaggaggctgagagcatgaagtcctgggggcgccatgggaggagatcccaggtggctcctaatgagccctgcatttccatttgcctgctctagattcccctaaggctactgtgaggctgggggtgggggaacagcaggtataagaggttggggtggctgtaggagggtaggtggcagcatggattctaggcaggctgctgcactgctggtgctgctgctgttaatagacgggggctgtgctgaagggccaggaggccagcaggaagaccagctctccgcggaggaagacagcgaacccctcccaccacaggatgcccagacctctgggtcactgttgcactacctgctccaggcaatggagagacctggccggagccaagccttcctgtttcagccccagaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttctgaaaaaatgtgtgtct

SEQ ID NO: 261621 - DNA, 231 bp, Homo sapiens
ggacctgaggacaaatctttcctaaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttctga

SEQ ID NO: 261622 - DNA, 541 bp, Homo sapiens
ccactgcaatgaaacaaatatgaaacctcacatggacattttactcttcagctgttttcatattttgctcacattttgcaaggaacccagagatccaaaagaaatatccttaactctttcccggccaagccctatgatcaaacacatgggaaataatctatggattacaataatcaaacagttctagagaatttctaaatatctgcaggaagaaaatctgtgtgcttttcaagtaaactgcagcaatcaggaaagaagagaaaaaccccttgcacaatcatgtatttaaaaaaaaaatctttctactctgcagatactgtttcctgaaatttaccaagaacactgccttgaagagataaaaaaaatacatccatagaattcagttctacccccaaaagagctgcactgcacacatttttagaaacataaatctcagcaaatacagttgcattttattgacaacattaaaaataatcacaacaaagaaatagcctttcctattccatttcaacttcattaccatgctctactagcctctact

SEQ ID NO: 261623 - DNA, 451 bp, Homo sapiens
tctatttgagttaccatatgcctttggctgtttatttctttcaagtatgagaaagcttacgtattcaattatttcaggttcaccactcacctcctcaggaagttcctggaaggagtcattaaccccaccacagcctttcccgtgctcccagttccaccactggaggcctgcatgtcaacggcagggatacatagagtgtagactgcaggctcacgatgggcagggatgcagtatctggtttcccacactccgcaaaagcacacaccatcctgtaaaccactgcaatcgataaagctgccttaacgagctcaggataccaaaacaaagatctctctgcagataacacctcatgagaagtatctgcaataaccccaagtcaacatttaggtttgtgtacaaaattaccagaaagcagaaagtaggacagaacgtagaaaagggcaaacaaaac

SEQ ID NO: 261624 - DNA, 522 bp, Homo sapiens
gagaaggcaggcagaagtgaccgtggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctgtttcagcccttcacatttgtatttgggtgtgctcagcttaaaacgatagcagcctgcaggagctcagccctgcctccatttatggagggaagagaaactaaggaatgctccttggggtggtgttggggagcagctacatgggaaaatgaagggtgcagcaccagtaaaaaggtgctcccaggactccctcccaccagcactcggaccaaggaagaagcatttaatttcagccagattcctagatggttgcttttatttgttttcatctgaatttgtgccaaggattcaacttttcctgcttattttattaaaaactttatacacagcattaataaatagatata

SEQ ID NO: 261625 - DNA, 140 bp, Homo sapiens
tgctcctccatgtccagtctcttgacaagcagctgaaatgttctttttagtttttttattttttctttgagaaagagtcctgctctatcacaccactgcactccatcctgaatgacgaagcagtacccagcctcaaaaaa

SEQ ID NO: 261626 - DNA, 884 bp, Homo sapiens
tctcttcactgggtctgtactccatagctattttaccactttctgaaataaagttagcaaggatgaattcagaatctttttcattccaaaacttcctgcatataatggtagcaacccacaatgagacattcttttagtttctaaaagcaggaaataagcattttcctgaaagtttcctcatctcttcatcatacacttcgatttttgtttttcttttttcttttagacagggtctcactctgtcacccaggctggagtacagtggcactatcatagctcactgtagcctggaattcctgggctcaagtcatcctcctgcttcagcctccagagtagcaggcactatatcactgtgcccatctaattctcttttttagagacatggtcccgctttgttttccaggctggtctcgaactcctggcttgaagtgatccttctgtcttggcctcccgaaatgctgagatttcaagcgtgagtcatcatgtctggtctcacagctcagtttttaacatatgtatgaaatatcaactgtgtttggttcaaaggactttatgatcttacagataggaactaaggaataataacataagaaataaaaaatgtggaaataaaaacgttcaatcataatatgattaaaaggtaaggcaccaggtggggggtcgaagtaagttcaaatccaaaatagagaccactgggctagtagacacttcacattagaagcatggctaggtgtctactccctgagaaccaaaattccaccagatacaatgaacaaagctttagagagagaaaacatttgaacattttacgggcagaaaatggcccacatactctatagacaatacaatttccttcaaggcaaactagaactataaggcttttg

SEQ ID NO: 261627 - DNA, 803 bp, Homo sapiens
aatatatccggcctatccccaatatgcgcgatgtacttggggagaaagtaacctctttccttttattcacctacataggttcgtgagccacacatctccccacaccaagctcctccatacaagacctcggactgcatcacgtaaatgctttttcaggggcaaaatctagagaatctgaaatgagctatcagcttcccagtttgcacaattcatcaagaaattatgcggggtcactggcacaaatgatgaggcatctcctggaagcttaacttcttatccatcccatctcttggacagatgatgccagttaattactttgaatgctggtctcgaactcctggcttgaagtgatccttctgtcttggcctcccgaaatgctgagatttcaagcgtgagtcatcatgtctggtctcacagctcagtttttaacatatgtatgaaatatcaactgtgtttggttcaaaggactttatgatcttacagataggaactaaggaataataacataagaaataaaaaatgtggaaataaaaacgttcaatcataatatgattaaaaggtaaggcaccaggtggggggtcgaagtaagttcaaatccaaaatagagaccactgggctagtagacacttcacattagaagcatggctaggtgtctactccctgagaaccaaaattccaccagatacaatgaacaaagctttagagagagaaaacatttgaacattttacgggcagaaaatggcccacatactctatagacaatacaatttccttcaaggcaaactagaactataaggcttttg

SEQ ID NO: 261628 - DNA, 502 bp, Homo sapiens
taggttaataacttgctaaagtcacatggcaagtaagtgtggagccgggatttgaacccagtcatcctggctcggggtccatggccctggctggccctggatgccgctggggggccctctgtagggctgacttgccctcctcagaagccccttccttagcttacggccacatagccctctggtagtcctcatcaccagctctgctcttaatttggccattttccgccttaggattggagtgaatcatccttcaaagacagagccacgttctgcactgtgttaagcatagtccgtggctcacagttcatgcgtgagccacacacacatgcacactttgttgggaagaagagcaacaataaattgcttatttagaaatgggcgaggccaggtgcagtggctcacatctgcagtcccagcactaaggaaggcagatgtgggaggatagcttgagcccaggagttcaagacctgcctgggcaacatagcaagtcccagttctccac

SEQ ID NO: 261629 - DNA, 273 bp, Homo sapiens
gccagcactgaatgcattttcaacttacgacatttgtgtcttatgatgggtttatcagaatggaaccctgtaaaccaaggagtgatttattttcttttatacctaagaccgggattctaatgaaataagggaggagcgggcaccctctggtgacactgccagacccaggaactgtgtggactcctgtgagggcctttcctcagcagcaccaaagaggataatggcaatcaccaaaaactacctgcagaccctccctgctgtgctgcaaatctt

SEQ ID NO: 261630 - DNA, 377 bp, Homo sapiens
ccagtaacaagcaccagatataggaaatggccctcagagatgcacattgatgctgcaggaaccaaagctcccagagctggagagagacagctgagcccagccaccatatcttccaccagacgcggattgcttaggatggcagctagatgacctggagatggcaaggcattctgaggctggaagggtgtgcagggaccagatcatgcagcacctccgttgcagtctgcagaggtttgacaatggaaagcctgatggcaatggggagccatggaagagtttcgagaaggggagagacaaggttaaatctggggctagtgtgggaggattcaggaatgaagggattagaggttggggtgagagagtccaggcaagaaacg

SEQ ID NO: 261631 - DNA, 303 bp, Homo sapiens
aactttattttgattcaacaggttggaaaccctctttttgtagaatctacaaagggacaatttcagagcccactgatgcttatagtgaaaaaccaaatatcccacaataaaaactagaaacaggctatctgtgaaaaagctttgcatatcatctcacagaattgaacatcggttttgattcagcagattggaaatattctttttgtagaatctacaaggggaaattttggagaaaattgagacctacagcatgaaatcaaatattctgcaataaaaactagagaaaatccatccataaaaatg

SEQ ID NO: 261632 - DNA, 4828 bp, Homo sapiens
ctcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccagaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggtccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatatatgtgtgtgtgtgtgtgtgtgtatgtgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcac

SEQ ID NO: 261633 - DNA, 391 bp, Homo sapiens
caccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccggga

SEQ ID NO: 261634 - DNA, 439 bp, Homo sapiens
acccattccctgctttccctcagggctggccttacgctcagcctcccctgtgaggtcctgggagcagctcagtcttcccttagggctgcaggggggcagtgccacccctgggcttgtgtttccctgctgggaatcctaaggaagggggaagcattatctttttcagaagctccagaaaatgtctcctcaagactcaatggctctatttgatttctcacccatccattaacttgctgctcttctggtgggtgtggatgtgcagttgggtttcagcctatgaagacctggcctggagctggggatgggttcggtcccactcaaaccacagatctgggaatggtggttccctggagcaaagtctgggtgctgtcaacaccaggagggggcatccgtggtgtcaagaagacccagaactgtctacttaatgtgccaaaggagg

SEQ ID NO: 261635 - DNA, 243 bp, Homo sapiens
ggggagtggctgtaaatagagatgaagcttcactggctcacctgctgctcacctcctgctcacctcttgctcacctcctgctgtgtggtctgtttcctaacagtccatggactggtacctgggtgggttccacagacagttgaggggttggggacccttgttctataccactgtaggatgactatagttatcaattatttatagtttcagatagccagaagaagggtattggatgtttgtaat

SEQ ID NO: 261636 - DNA, 479 bp, Homo sapiens
ttctttgatttagtgttgtttgaaaagcaaatagatgttaaagtttgtaatccagagagcagttttgtcttaaaatccattcactgctccatgcagtagagagaacaaaatttgattaaaataaaacaaagctttctagaatatgtttttttaaaaaacaggaaatttgtaggatttgttaagaatgttagaaattggccgggcatggtggctcatgcctgtaatcccagcactttgggaggtcagtgcaggcggatcatttgaggtcaggagttccagaccagcctggccaacatggtgaaactccgtctctactaaaaataaaaaaattagccgggctggtggtgggtgcctttaatcccagctatttgggaggatgaggcaggagaaccgcttgaacccgggaggtggagatggcagtgagccaagatcgctccactgcactccagcctggacaatagagtgagactcagtctcaa

SEQ ID NO: 261637 - DNA, 381 bp, Homo sapiens
cacgagggcgatcagccttctcaagacacctgaccaggcctgtatctagacaaacccttaatataatcatcgtcagtagatgaggaaggtcttcctttacaagttcccaccacacttccttctttttgtccctagttcttctgttttgttgctaccatcaccagccattgcccatgaaacaaacatcttcttgcagtaggcttgggcctgtgctagtaaattacaggacaacactcgttaggtgtgtggccttgcgcccctttctggtggttctggcctaccatggtggcagctcctcttcaaggacaagagtagacagaatatcagaaatgtgtctgtgtttctcaggacagtcattggtgcttagcactagtatgatga

SEQ ID NO: 261638 - DNA, 457 bp, Homo sapiens
cttagccctgctggaatgaaagactccagctgccgtctagatgtcactcacagtgacagaggagaaaactggggtccagcgtgctaaggaagttttccaaggtcacataaccagtcggtggtgagatttaggctagtgtgatttacaaagtcttcttgggtgggagtactcagggttcttcaaagcacaggttctagagtcagacagcatagattcaaatgctggccctgtcacttactagccatgtgaccttggacacattatacctttctgtcgttcagtttcttcctcaccaaaataagaaaaagtacatgatcacatattgtcgtaagaataaatgagttaatacatctcaataacaagttcacaatcccttattcacaattctgaaatctaaaaactctgaagaccaaaagttttctcataagttttagtaaattatttggtggcaaaatct

SEQ ID NO: 261639 - DNA, 427 bp, Homo sapiens
ttacatcgtagttctgtaacccagaataagtgcaaaatctcatctctagaaaacacccaaggagggttctaattaactctagggtggtagcggcggaggaggggcagggagggaaggtgtttcactgggggctgtcaaagttattttagtttgctctaaattgcgtcggcatgcccggaagctctttaataattgtagctaccatttactgaatgcttcactaggtgccaggcataatgttcaggcgtttgagggaattctcatttcatcttcattaggacacgctgcaaaaatggaggctttgagaggtgaaatgactggctcaaggtcacacagtgagatagtaagtggttagggagatcaggatctgactccgggctgagtggttcttcctgcttggtccacgccctgttgagatgtttatttg

SEQ ID NO: 261640 - DNA, 427 bp, Homo sapiens
gtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaatac

SEQ ID NO: 261641 - DNA, 460 bp, Homo sapiens
ctctagatccccttggcccccttccctcaattcccacgcatctcctggcagagccccagtcctgccctactgggtccaatcacttctctcccatgcctccctctgcctgccagccaggatagaaagagcctgttgctcaggtcgagtgatgctcctgagccgacagccacttgttggtgccctaactctggtctgtgctgtaactctatccctgatgctgcctccggtgacccttggtccttccctaccctaagctgcacacacaggagactgaaagagacaagggaggagggcttagccctgtcaactcaaggtgtccacacacccagctctgcagggtccttggaggtcaaaacaaggtggagacaagggacaggcctgagaggctgggggctgtgcagttgggcccatctggtgttcctgaggttctggggagaggaagccccagttgtgctggtag

SEQ ID NO: 261642 - DNA, 480 bp, Homo sapiens
aatgtaacatcacagctctgaggttccctttccatccccagtttctctgatagagcagaggactctgaaaggaggccagtttttttattctaaccatgggaaatttgaaataattgttgacttcttttgcttattttttttggtccctaaaatatttgattggtcaagataaatcatctttgttttatttttcatttctgataattatcagaataataactggataagtcccagtgaaagccccaactgaaagaatttgtagtcatgttgtcacattttatatttaaaagtgtttctctagagttaaggaatgaattttttttttcccagatgtggatgcaagttacaataaattcttggcccttttgaaccattagggattaatcattttgggttaaccattttctagatggtgagaatttattcttataataaccacaaaacttcaactactttattttatttttattattattattt

SEQ ID NO: 261643 - DNA, 294 bp, Homo sapiens
ggaaacaccaaaagaaggccactttggctccaacgcctactctgccaccaatcacagggctgatcttaggctgaacacttaacctttctaggcttcaggttaacttaaataaaaactatactactactttctagacaagatcttcacatggaccaaatgaagaagagaaaaaattaaagacaaaaaccaaacatcatttggaaaaaatctcaaaggagcaaaaaaaacatatatccaaagtagtcttcctacaaccaatttccttctctaatacattccttctacgacaaacaa

SEQ ID NO: 261644 - DNA, 748 bp, Homo sapiens
gcacagcacctccagtcactaatggttgtaagagacttcggggacactaatcttaatgcgccatttcctataggtcttgttagttcctaaaaccatctgtaagaagttattgtatttggctttcttcagccatattttttaagcacgacatttaattagtgcttgttaagatgtttcaagtgctttggccacttctctcacccctgctgtttcttcatggtcagcatattttctggaaatgttgttttcgggaaagggcatcagatgcgtctgtgtctggagaattgctctgtgtatccatgtgaagcaagtctctgagagcaactggagggactgtcaggctggctgtggggcctccgtgttcacagcagctactttgaaaggcctccagttttgacgttctcatggaaaaagcagagacctcaaaatgggtttggaaccgacaacaataggagggtacactggagccctggagaagaatgtcacataagtgaaatgtatttgaaatatttaatctaggaacctttggattaacttcattaaaaagagtttgcttgaaagggcataatttttgctcgaagagaccttatgaaaactgcaaaatggttgatggtactgaaatatccacccatgctcactaaaggaataaataggttgaatataattccattatttttgcaactgtttaataccataaaattcattaaaatttcaaactgctttacaaaataagacatttttttctaag

SEQ ID NO: 261645 - DNA, 711 bp, Homo sapiens
agcagcatagaaaatgagccccccatccccctgccccatggcccaccacacaggttaacagatgttaacattttgcattggcgccttgtttatggctgtcttggagatagccccgtgtcgcctccagctgcctctttgtggtaactgcccaagagtcgttattgattatatgcatgcacccaatattcattattcgacctgttccagctcttggatatttagcaaattactgattttctgcttatataattgtggtggaggtaataccccattttgtataaattttgcccgggtgggtgggcttcgaggcaaaggagaacgaggctcggctttggattaggttcacactcctgctccgccacacttctagttgtgtgatctggagtaagggaaggccctcactttccccatctgtaaaatgaactggctatagtaatccctccgtctcatagctgctgagaggaatagaaaactaaagtatagacgcttcactgggcttagttcccagtttccctggctagggaggtctccgcggggacaccaaactctcaagcccagcctagcagctagagcgcccagcgcctgcacttttgctttaaactacaacctgttccccgcctctcttcctccgccgccacgctgggggcgtggcggttaaatgtctctgtgacgtcagcgcgagcagggccaatctccttgcccggcagacgt

SEQ ID NO: 261646 - DNA, 273 bp, Homo sapiens
tttttttttttgagatggagtctccctctgtcacccaggctggagtgcagtggtgctatctcggctcactgcaacttctatctcccagcatttcaccatgttggccaggctggtctcaaactcttgacctctggtgatctgcccgcctcagcatcccaaagtgctgggattacaggtgtgagccaccgcgcctggctatccatccttttgattatcgccattctagtgggtgtcaagtggcatttcattttggttttaattttcatttccctg

SEQ ID NO: 261647 - DNA, 480 bp, Homo sapiens
tctagcctggcgacaaagcgagactccgtctaaaacaaaaacaaaaacaaaaaaacaataacaaaaaagcacagaactgtagtgaagaagaaagatggcggacgcacataactgcatattaccaaaagatttttttgtttcttttctttttcctttttgcaagagaaccgggattaaaatctaagctttctaagtctctggatctgtaccctctccaccagctgacagtctgctaataacaatatgcactctcaaggatcaagataagcactgcaatatattcattcacaaaataatgaaatgtaagaaacctatatatgaaaaacattttcatgtctcactctcttgcttttactctgtcactattcctttttaattttttatttatttttatttattttatatctctattaaaggcttacccttaaattgtatttggaaaataaataaaaggaaaaatcacatattctcattatacta

SEQ ID NO: 261648 - DNA, 215 bp, Homo sapiens
atctttatctcaatcattattaaataaatatctgagtgtactatgccgctgatggtaactggttgttgaaaacaactatgttttaggtatattaaagtattattgtattctaaatagggagaactttatatttcctaaggaaatttattagacaaataaggttctagaaaatatgacttgattttaaaaatggcctttatcatgagagatcgcag

SEQ ID NO: 261649 - DNA, 331 bp, Homo sapiens
aatgatcaataaaaaaaaaaataataaaataaaaaataaaaaataaaaaaaagaaaattaactttggtaccaggtacaaaccagtctgggagcagatcagcaaagaaactcttgaaataaacggttaagataaaaggagtaacaaaggtgtaataccaacgcatcggcagtggcgctgaccttagaaggcttccgacagtcaatcacaatacttcaggacctatcagaggtaggatctaagcctcccagagtccccgcacgcccttgtcagcttccctgctcctctcctgatgcttcctgggatcacttccgaaataaattacttgcactt

SEQ ID NO: 261650 - DNA, 210 bp, Homo sapiens
agaataattgagaagtggtatcaataggatctggtgattgattggatttgagaactgaactgaggaagaagggggaaggtgttaagatgatttccaaggttctggcttaagagttcagtgtgtaatttcaatgtgtgtaatttcttgagataaggaactctgggaacaaggcagatttgggtagagtgtggcagcatgtgaaggtaagtt

SEQ ID NO: 261651 - DNA, 161 bp, Homo sapiens
ggcatgccagaatgcagcacagcctcagctaacctaccagggtgcttttgccagtaaccactgccatagcactttctttggaggcccccccaccccaccctactggaatgagtaggaagcgctctggtgggaggctgtcagcaaaagcactccagtcgacg

SEQ ID NO: 261652 - DNA, 310 bp, Homo sapiens
aagcaccagctttgctgaggaacatggaagggggaaaacaccgactgtgataaacaccagcaggatgactggagtccgctggaacctggaatggagttttctgacagcaaaggattacaggagcgtaacagaaattatggagatttccccgctaggcataaggatgcgatcactgtaggcacctgtgggcccaagcaggttacccaccaatatccctttaaacaccaaattatggactattaggccactgcttcaaggcttctacaaatgtgaaaccttgacaaattcccaaataaaagccataaaacca

SEQ ID NO: 261653 - DNA, 431 bp, Homo sapiens
tgtaattaggaatgtgctggttatgctgctttcaacatgaaaccttagttttcataggaagcagaaagcctatatcaatctgttagcacttgtttacatacctaaccctacttggagagcacagagttttctagctatttagcaatggttaaaagatgtttctggttatatttttcatctattttgaggggctaaaggcctggttatttaatgttgttttaacctgtggacttagttcattctcttcttcagcttttctaggaacatatcgtgagtatttccatgcattactcgccttcaggtgtcatgttcttgttcctctgaagtgttcaatgttgactaggattaatggatcctattctgtaatctgctaggctgaaaattgatgtcttgcaaattccatgccatcaaatacattttaacatggaacc

SEQ ID NO: 261654 - DNA, 423 bp, Homo sapiens
ctactttggcctcgcaaagtgctaggtttacaggcatgagccatcatgccagaccacaaagacattttttattaggccagtggatgttcggatcatctttaaacaacattgaaagttgaattgctgacagtaatatggggatagcattccagggagagaaaatactatgtttggtggagaatagatgaatttggattggggaacagaagatatttttgatgggtaggatggggtcatttcataaaggacatgaatttttagttgagacatttgggcttgatcttatagaccttaaggagccatttttggggtgtggggaaccatttttgacccttaagctacctaagtatttattaatttggtttgatgataatattgtgtattcttagttgcaggcttttgcatagagagtataacttgact

SEQ ID NO: 261655 - DNA, 721 bp, Homo sapiens
ctcttggcaaatagatcccactctctgagggttgtgttggggctcagaaaatactaccccgaagtatgacactttggcatgctgaatactttgaactaaaagagattggaaggcctcagaagcagcctcggaagcagtctctccctctgatctcctgcccttctgtctcctgcccatctttcgtcccagaagtgagtcacagaaaccagaattcttccccagcgcacttaacttggactcaccacctatcaagtgctcgacagccacgtgtgcagtggttcctacgtggagcagcatacatccagagatgcaaatattaatgaggacagtgctagtaacagagttgctgagcaatctatgtccccttgtaagaaccagtgccccaggggaagaaacagaactccacaaggtagcagtgtgggtgtagtacccgcatgtgcccatgttatgggaatgtagatggggagtgaccaccgccaacagaagtgtggccatcttgcccgagatgcctgaggacctcctatttttagatgctgctgcccaaggcctgtatttcatgctatggcttttgtcatttgaattatcagtagctgtctcggagctattacgcttcactgggccctggaggatattgtcttatacagtccactgggttttggatatgcagtctgtgcctttcattgccttcctggaaaataataactaaactcttcctcaccag

SEQ ID NO: 261656 - DNA, 636 bp, Homo sapiens
gagaggattcctacatggagtgggagactgaaataataacctcaaagatgccttccaatcagaagatttggtgattctttctgagttatcaaactgccttcctttgaccttgctcacatgtagaaatccaagtcaggcgcacttaacttggactcaccacctatcaagtgctcgacagccacgtgtgcagtggttcctacgtggagcagcatacatccagagatgcaaatattaatgaggacagtgctagtaacagagttgctgagcaatctatgtccccttgtaagaaccagtgccccaggggaagaaacagaactccacaaggtagcagtgtgggtgtagtacccgcatgtgcccatgttatgggaatgtagatggggagtgaccaccgccaacagaagtgtggccatcttgcccgagatgcctgaggacctcctatttttagatgctgctgcccaaggcctgtatttcatgctatggcttttgtcatttgaattatcagtagctgtctcggagctattacgcttcactgggccctggaggatattgtcttatacagtccactgggttttggatatgcagtctgtgcctttcattgccttcctggaaaataataactaaactcttcctcaccag

SEQ ID NO: 261657 - DNA, 471 bp, Homo sapiens
gagaggattcctacatggagtgggagactgaaataataacctcaaagatgccttccaatcagaagatttggtgattctttctgagttatcaaactgccttcctttgaccttgctcacatgtagaaatccaagtcaggcatggcctcatgactcaatcctgggggacatgagataaaggtttatgggaaaagtttgataacaaaaaaatagatgtgcaaagagatacttcttttacttcctctggaatagagtcatgtgaagaggtctttacacatagactctaactatgacatcaatcctgaaactgggagaggacaaacctgagataaaagccttgttggagatgcttcagcagaaagatggaaagatcctgagtgtttgatgacatccttgagttgcaggattaagcaaccctgaacctgcccatgctgggcttcatgtaatgtgaagtaataaatattacttcaagac

SEQ ID NO: 261658 - DNA, 181 bp, Homo sapiens
gtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctattt

SEQ ID NO: 261659 - DNA, 530 bp, Homo sapiens
ataatcatatctaagatctatatctggtataactattcttgttttatatttattatactggaacagctcgtgtccttggtctcttgcctcggcgcctgggtggcttgccgcccacaaacctctgtctttacctcccaccatatacaaaatactaactctaagtggaccataggcctaaacataaaagctaaaactaaaacttctagaaagaaataaaatatttgtatccttgcactaaagaaatatttcttagatagaacacaatgcaaatgaaaaatataaaagtttattttttattcttttaattttttttttttttctgagacaaagtctcgtccttgcactccagcctgggcaaaagagtgagaccccgtctccaaaaaaaaaagacatgtttaagaaaatgaaaatagcccaggcacagtggcttataacctgtaatcccaacagttacggaggccaaggcagtgggattgcttgagcccaggagttcaagaccagcctaggcaacacggagacctcatctctac

SEQ ID NO: 261660 - DNA, 517 bp, Homo sapiens
atacctgcactcttgtggttattgcagcactattcacaatagcaaagatacagaatcaacctgtgtgtccatcagtggataaaatggataaagaaaatgtggtacatatacacagtagaatactatttagccattaaaaaaatgaaatcatgtcatttgtggcaacgtagatggaactggaggtcattatcttaactgagataaggcaggcacaaaaagacaaatatctattgcatgttcttacatatgagagctagaaaatttgttcacatggaagtagagagtggaaaaatagataacagagactgagaagggtgactgtgagggcaggagaggaggaagagaagtgggtgagaggttacagacatacagttggaataaatgtaatgttagcagagtagcataactatagttaaaaatgtattgcatctgggtaatggacaccctaaaaccctgtcttgatccctcactatgcattatgtaatgaaatttcatatgtacccccataaatttgaac

SEQ ID NO: 261661 - DNA, 371 bp, Homo sapiens
tttttttttttttagatggagtctcgctctgtctcccagactggagtgcactggcgcaatttcccaaagttgtgggattacaggcatgagccaccatgctgggtgcaatgtccttttttaagaggcaattttgctctaagagaggtagaagagtgatatgggagtagtgagattggagagtatataaatgccagggcaaaaaaaacagagctttctacattattttcctttcaaacttggagaaccaagacatgcatgtttctatgatgtttgagatttttcagtaaagtagggtaaatgaataaagaaagagagaaacagaataaatataatatggaatcatgtcttttcaaaaggtaagtgagatagga

SEQ ID NO: 261662 - DNA, 654 bp, Homo sapiens
gaactacagatttcattattgtataaataaccaaagataaggagttcctgatgtctaggtgttctactagattgcatggtaaaaaccagagctgtgtttaattatcaattactgcgtggtagaaaaagggaaaatgaagatgaacttttaaaaggggagtagattagggaggggtaaaatgtctcacatttgtttcttagattgctgatcttgtctccagagtccctgttattagcactgcccttctctgtccctcccctggagcctaccctaagtgacaattagtctcatagcatctgagaatctctgaaatctgctttcatggaagcaaatgaaacaagggtgcattcctgtcctggtgcgacagaatcctcttggattccatggcacagagttactctggagcagagataatctgcatcaccacactaaagtgctagaatatgagaccagcctccaagtacttccatccggctgaagaaagaaaatgggaaatgggttttactgcttctctaaacatcaggtccctctacttctctctagtggtgaatgaaaggatcatcaatgttggcagatatttggccagcccaacagcaacatcaggtggttattaggagttggtgaataaaatcctccttctgttaaaagtgttaa

SEQ ID NO: 261663 - DNA, 409 bp, Homo sapiens
gaattccttgggtctaagaaagagggttttagtatcttttccttaagctcttttatccaatttaaagagttatttaatccattcagaggtttccatggtcaggccttgatttgataatctgtagtaagtaaacacaaatttgataatttgtgtttgaatctgcctttgacttcaagtgaatttcctaattttattttttgccatatgtggttaataataagcaataagtctctgccacatgaattgcacaatttggggacaatctctattattcccttttattcttacttacaaatcaaacaattctcttttcagctgatttcttttcttgtaattcctccataaatgcagccaatggcaactaacacatgcttctaaatgttgtcatccaacctctttccctagaact

SEQ ID NO: 261664 - DNA, 467 bp, Homo sapiens
tttaaaaattctctatggtcatataggaaagaaaaatgacctcatgcttgcaaccacaaattcaaaatgctctggaatctgtaagacgaactgcattttaattagaaaagagaaagagcaatgaagacttttattggatatttttgcaaaccctcccttgccttgccttcaggccaaaatgtgacaagtgccctaaatctgataacaaacacacacttctgaagtcattgttagctttcctaaaaagaaaaaaagagtcacattagttttctgttaccaataagagttcaagaatgcagtcttaaaataaagcacatgacaacacaaggagtatcctccatcacacttcaaaaagtaaaaatggagctctcaacccattttcctctctgcttagaaactttttttgttatgtcaggtcctcagaaccttgagccaggcaatattaaaaagccttgtggtttattcct

SEQ ID NO: 261665 - DNA, 668 bp, Homo sapiens
gccggatctgccgctccttctcctgctcctgcaggcgctggatggcagctgcctctgcacctccaggtactcctgcttcttctgccgcattatctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggtaa

SEQ ID NO: 261666 - DNA, 491 bp, Homo sapiens
catttgaaacaaatagagccagaggtatagctaagcataagaggggaatgaggagaagctctgaggatggttggaaacattggaagaggagtcggcagctggcccagctctttgagcgaagctgctgagaagggacagaagatagtgagaagaaccttggatatagcaagaagtaccttaccttcctaaagccatactcagttctcacaaagatctaggggccatttactggccacatttgtcttctttgagcctgattgtcagagaatttggacttgtagagtgggccagaagggatttaatggcagcatcaggaagcactttggcaggtgtgaagattataaggacctcttgagtgcaatgcccagggaaactgtgtcacttttctcagaagttcctgaaggcttttcaggaatattctgattttaagtgacagaaactcaactcatatcaacttagcttgtaacaatgaataaaataagaatccatga

SEQ ID NO: 261667 - DNA, 261 bp, Homo sapiens
aatcctttctttcttagaatcaaaacatggtagaactggaagatgccttggaaatgagatactccagccactttcttttccatctttttgaaagggaatgtagtgcagtgcctaacagctgggctctggcatctataccttccgggttcgaatcctagccctgtccccagggacccagaggaggctacttaagccctgtatgcctctctctactcatctgcatgagaataaaaattgtattatgttggtgaaaaaaaaaaa

SEQ ID NO: 261668 - DNA, 1022 bp, Homo sapiens
cttgaactcctggcctcaagcaatctgcctgcctcgggttcccaacgtgctgggattacaggcgtgagccactgtctggcccatttatttatttatttattttgagacagggagaatcacttgaacccaggaggtggatgttgcagtgagccgagattgtgccactgcactgcagcctgggcaacagagtgagactccatctcaaaaataaataaataaataaaataaaataaaataaaacataaaaggtaggattattttattttgaaatacatacttcacttatcaggaaagatgtttcctgaggagcccatgacagtcatagttttcttactctttattggctggtggtaaatatgggaatgccgtcaacaaatgtataatgcctaataaaggcggacttttttctcaggaagtagtgttaaatttttttttcctttctttggaattaaaatagttactgaaggggaaaaatgtggatttcaaagagggattctgcaagataattttgtgtgttttttttttaaacatcagttttaatgcccttcagtaacttggttcattaaaaaaaaaaaaaaaaaggctgaagtaaaaagagacagggtctcaacactgtttcttcaatgtttgaagaagttgccaaagtagagagatttgagtataggtgagatcgaaagaggaaatgtttgggactaaaggaatttcaaacttgtaaagggcctaaccacgcctttcttgacatcatctctctggcatgtgttattataatttaactcctcataggatcaacaaccatttcctttggaaaaaaagaaaagggactgtgtttaacttaggataatttgccttctccaacgtacttttcatacatttctatttcttctcaatgttaatatattgaagactgatggggagtaggaggtgatgaaagtaaggctgactggtgggtactgccagatcctcattctttgagaagcttgttacctgagattgtcatgagtgtttactcaggagagagaagt

SEQ ID NO: 261669 - DNA, 969 bp, Homo sapiens
cttgaactcctggcctcaagcaatctgcctgcctcgggttcccaacgtgctgggattacaggcgtgagccactgtctggcccatttatttatttatttattttgagacagggagaatcacttgaacccaggaggtggatgttgcagtgagccgagattgtgccactgcactgcagcctgggcaacagagtgagactccatctcaaaaataaataaataaataaaataaaataaaataaaacataaaaggtaggattattttattttgaaatacatacttcacttatcaggaaagatgtttcctgaggagcccatgacagtcatagttttcttactctttattggctggtggtaaatatgggaatgccgtcaacaaatgtataatgcctaataaaggcggacttttttctcaggaagtagtgttaaatttttttttcctttctttggaattaaaatagttactgaaggggattaaacatcagttttaatgcccttcagtaacttggttcattaaaaaaaaaaaaaaaaaggctgaagtaaaaagagacagggtctcaacactgtttcttcaatgtttgaagaagttgccaaagtagagagatttgagtataggtgagatcgaaagaggaaatgtttgggactaaaggaatttcaaacttgtaaagggcctaaccacgcctttcttgacatcatctctctggcatgtgttattataatttaactcctcataggatcaacaaccatttcctttggaaaaaaagaaaagggactgtgtttaacttaggataatttgccttctccaacgtacttttcatacatttctatttcttctcaatgttaatatattgaagactgatggggagtaggaggtgatgaaagtaaggctgactggtgggtactgccagatcctcattctttgagaagcttgttacctgagattgtcatgagtgtttactcaggagagagaagt

SEQ ID NO: 261670 - DNA, 2009 bp, Homo sapiens
cgggcgtgcagacaaaatacatggatgtggtcaaggagcgaatccgtttagctcgacagattgagaaatctgagtatcggaacttccaggcttgcctgcacaactcttgggattgagcaggcagcagctgccctggagattgagctggaagaagacatgtataagggaggaaaagctgaccagcaagaagaacgtcggagacaaagcagatgaaggttctgaaggaggagctgcgccacctgctgtccagccactgtttacggagagccagaaaaccaagtatccactcagtctggcaagccgccccttgcttgtgtctgccccaagtaagagcgagtctgctttgagctgtctctccaagcagaagaagaagaagacaaagaagccgaagagccacagccggaacagccacagccaagtacaagtgcaaattaactggtcaagtgtgtcagtgactgcacattggtttctgttctctggctatttgcaaaacctctcccacccttgagtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagaaaaaaaaaaaaaaccggaaccggcggcaccagctcggagagaaatcgatgttgtagtgaccttcagtaaaagagcggtttttcatagaggtgccgttttagactacctatttaagaggcacgaaaaacaaatacatctaataggttaagtaaaaaaccatctatttcggacaataaaagttattttctacacacgttggtcttcattttactcgttaacagtatcatacatccttctaagcttatctttttgacgtgaaagtgtagtagtatgtctccacctggcagctatgtagttaatatttttgtctgttgtaatgttatcaagtaccgaacattttcctaatgaaatagtggaaaagacaacctttttctccatttctatttggatttttagatcacgtacataacaaggaatcgaataaataatgaagtgttttataaagagtatccgtcttggagggagattccagttgggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatccccc

SEQ ID NO: 261671 - DNA, 898 bp, Homo sapiens
taaagaaaaaacggttacccagcaactagaaaaacaaccggaaccggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatccccc

SEQ ID NO: 261672 - DNA, 1528 bp, Homo sapiens
taaagaaaaaacggttacccagcaactagaaaaacaaccggaaccggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatcccccaaaaatgttctttagctcctgtttcactcctagtggtaaagaatttcactgctttttaaggatagtctatttaattttggaatttttagaaagataagctgggacaaaaatctgcctccttcagcctggccaacatggtgaaaccccatgtctactaaaagtacaaaaattggccaggcgtggtgcgcacacctgtaatcccagctactcgggaggctgaggcaggagaatcgcttgaacctgggaagtggaggctgcagtaagccgagatcgcaccactgcactccagcctgggcgacagagcaagactctgtctcaaaaacaaaacaaaacaaaaaaaagcctctgcctccttgtaagtttaacccactggttttcatttatcatacatgtattcaatcatttattgaaaatgtattgagtactattcatgtgctgggaattagtagtgaatacttgttcttacactcatacaacttacaatgctttattgttttgctctccagaaccacacagaacaagactaataacatcatattgtaaaaagcaaaagctatcatatcatgctgccttcttcagttaaaacttcccaagtttttaaatatacaatggtaatgcctgtttaacaaa

SEQ ID NO: 261673 - DNA, 1512 bp, Homo sapiens
ccggctggtacgcccccgggttatgggatggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatcccccaaaaatgttctttagctcctgtttcactcctagtggtaaagaatttcactgctttttaaggatagtctatttaattttggaatttttagaaagataagctgggacaaaaatctgcctccttcagcctggccaacatggtgaaaccccatgtctactaaaagtacaaaaattggccaggcgtggtgcgcacacctgtaatcccagctactcgggaggctgaggcaggagaatcgcttgaacctgggaagtggaggctgcagtaagccgagatcgcaccactgcactccagcctgggcgacagagcaagactctgtctcaaaaacaaaacaaaacaaaaaaaagcctctgcctccttgtaagtttaacccactggttttcatttatcatacatgtattcaatcatttattgaaaatgtattgagtactattcatgtgctgggaattagtagtgaatacttgttcttacactcatacaacttacaatgctttattgttttgctctccagaaccacacagaacaagactaataacatcatattgtaaaaagcaaaagctatcatatcatgctgccttcttcagttaaaacttcccaagtttttaaatatacaatggtaatgcctgtttaacaaa

SEQ ID NO: 261674 - DNA, 432 bp, Homo sapiens
tagggaacgttagcagagtgactataaaactggatcagcctggcagtcaaggttaccaacaagaagcaagacaacattccagccagaaatccactggtcttaaaaactcctcagctgggacagacaaccacaaaagttgtgtgagaagataatccaaaagttgtttgaaatgacaactgtttccttagtaggagaacacctttcaaacaccagatttgaatttagaatacttcagaggaatcaacacatagtaacattatttcatggttaaggtgtttagatacaattttccatgggtctttcatatttctgcatgtcttgtgagcagagggtgtttttctgaacagctttggaagacagagatggtgcccttcaagaacaaagggcaggttggtttgctctctgatataataaagataacgtctccctcca

SEQ ID NO: 261675 - DNA, 390 bp, Homo sapiens
gagacagcagctgagacggcagcggcagcttctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggtcagaggctgcgggttgg

SEQ ID NO: 261676 - DNA, 1757 bp, Homo sapiens
gagacagcagctgagacggcagcggcagcttctcaggtcagcctcctccgggcctctccccactctcctctgcccagttctctgtccttatccacaggcccctcagtgggcactggccatacccatgtccaggtgggcacagacctggtgatatcctggtgagcaagctggggacccaccctccttccctttctggttggcagctccacatctggggcaatgtagagatctgtgcttttggaaggaggggcaatttaaattaagaagtggttaggcatgggtctcgaatcttagcttccccgcgaggtctgggacaagtgaagagaggtttcttttctggacctcagtttctcatctgtaaaatggggtgagtctgggaacctgcaccttggatggctgtcaggggctcagtagaggacctggcacacagtttgtgcttggcaatctggagcaggtgcagctcctttcagagtgacctggattggatcctggggacagcatgtctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggtactgctgggggcgcccccgtttccactgcacccctgcccctctgtgactctcctgttgaacactggtttgactagacccaaacctgtggaaccatcttggaaatccatcacactttgaaaattcctgctcaagaaataagagagagagaagtttttactcatgcatttgtcagaattctttcagttgcaagtaagaaaagaccacttcaagccagcttgagcacagagggaactgattggcacacatccatgaaatgtctagaggtgatccaccagcttcagacatagctggatccagggatggatctgatgcccttgtggctcagtctctctccgtctcagcaatggtctcctgtcttggctgtccattctgtggcatgatggatgctggagagccagacttcctttccctcttcccatcaggctcttcccccgactccccacccacaacctgccccagtgcagatcagggtctcaggatcttaaaggttcagctgggtcacacatgtccatccctgcacctgtcactgtgcccagggggatggaatgtgtggattggccaggcctgggtcacacggcccagggactggggtgaaggagtgagctcctagggtaagtgcagatgctgatcctggaacagagacagggctgcttgttgggggt

SEQ ID NO: 261677 - DNA, 703 bp, Homo sapiens
aacaaattatcattatgttaatactttactttgaaaggtgtcattattttcaagacgtatcatttaactgatctactttatctagttacccacacctatgacttccataagtgaaatgtctttatcagtgaaaacaaaactagcctggataaatggagtaggattgaagacctaaacaaaaagccattcttgagctgcccaggttgtgtcctgcccacagtggcccccaagatcacctgagtgggaggtgaaatccagcctgctcttcccttcaccaagttgctcaccttgacacgggctgcatcagcctggaggacaggctgcctctcccaagtggttctgccataatggctgaaattttgtaatcattactgggtgaagcagaatgcaatttttcacctttgtagtgggcgtataatttataacaataaaaagagaaaatgatggcagataaaatagagagtatagcagaagctagaagtcatacagctcttaattgttaaagccaagaccctcagtggagggtctgtcaaaggcacctcagtactaatagccactggcggccttgtgctaaactcccctttacttgttcactaccttcataggtttaagggcatcaaatactgctcctttttcattgcttcacccagttcatgagtgacatggtatcagactgtgcttgagtcagacatgatgctagttg

SEQ ID NO: 261678 - DNA, 485 bp, Homo sapiens
gctcggttttcgagtagagtctgcctgtgggtgagattgctcggctctgtacggcgcttagcatctttctgactgcaatgcttgtgtatttcttaatcgtagctatcatttgagtttttaactatgtacaaggtattgtgctaagcgctttacagtccttcataattctcatagcagccccatggggaaagtactattattattcccacttttacagatgacgcccagagaagacaggtaatgtgtccgaagtcacgcagcaggaaactaggagccagagtcaacctaggaaaactgcatttagaacaggaggtctaaccactgtgctctacacgcgggtggttttcacttcgtgaagttttggggaatgggggtagtgcttgggttataatcttgcagttgggatcaggccctttagggcatattccggctccagacccgccgctcagcttctctggctcccgggcatgggaatctggactcgg

SEQ ID NO: 261679 - DNA, 1398 bp, Homo sapiens
tgagtctttatccctttgtaggtctttacttcttaacttagggattctcaaccttctctaaacataatcacttagggagcttttaaaacccaaagttaggatgcacccaaagccagttaaatcagaatccctggggatgcaacccaggcggcagcatttaaaaaatacccaagtgattccaacctacagacaaggatgagaaaactctcctaaactcttgtataatgacatcggcatgaaaatgaactcacctgaaactgaccttcccaggacattaagtcactagttggctgcttatggcacttgccagtgtccagcagtttcctggctgctcctggaggttgccagacacccggttcccccattctcaatgttggaggcccacagtctctgcacttaggggaccagctgtaacctccccacctgaccagatgaaccgcggggaaacaaagcgagaagctcccacctacaggatgcaaggacccaagctgggatttgtgagagtctcagcagaggctgtgaggaactccacagaaaatgaggcaggaaagcaaaagttccttgttagggcttggaggaggagagggttgtcaagcatgttttctttattattcccacacataagggagctggctttaagagctttctgtgacaaacctgaggagaaaaagccctgagacttagaaggcatttaagaatacagctcaagggggaaatcggtggagactgtatctgcggtggttttctccacctgtagccagaggctctctcatagggttctgtggctttccttggggtgccttttaaaggcatcccagtccagcccaggactgactggattccaggagatctcagaggctggtctgacaccaaagaaggctgtaaagagaagagaccatttggatgactgttttcatggaaagtgagccccagggaggctggcctgagattacacagctgattatgggcctcagcctgactcttaaaacaatgcttgtgtatttcttaatcgtagctatcatttgagtttttaactatgtacaaggtattgtgctaagcgctttacagtccttcataattctcatagcagccccatggggaaagtactattattattcccacttttacagatgacgcccagagaagacaggtaatgtgtccgaagtcacgcagcaggaaactaggagccagagtcaacctaggaaaactgcatttagaacaggaggtctaaccactgtgctctacacgcgggtggttttcacttcgtgaagttttggggaatgggggtagtgcttgggttataatcttgcagttgggatcaggccctttagggcatattccggctccagacccgccgctcagcttctctggctcccgggcatgggaatctggactcgg

SEQ ID NO: 261680 - DNA, 308 bp, Homo sapiens
atccaaaggatctcacagcgtggttccaatgaagattctgctggtgttctaagagtagtatgtgatggaagagctgcctcatcacgtagcagatgaaagcacagtggcctccgcaaggtccagcccactgcatcagtgccagactcacacggagtacagatgcaatagctggagccacagaagccatattgtgaccatcaggcaccttgaacttgctggcctcgtgctaaggctcttagcgcagaagagtccggatatttcctgattactctgacacaagagaaaaataaaacctcaattcacttaaa

SEQ ID NO: 261681 - DNA, 443 bp, Homo sapiens
  misc_feature (7)..(7): n is a, c, g, or t
  misc_feature (262)..(262): n is a, c, g, or t
  misc_feature (279)..(279): n is a, c, g, or t
  misc_feature (426)..(426): n is a, c, g, or t
gaacgcncgacaacgataagaaactttttttttttttctttctttctttctttctttctttttctttctttctttctttctttctcgctctcgctctctccctccctcgctcgttttctctctctctcgctcttgccctctcgctctctccctcgctcgttttctctctctctctctctctctctctctgtctctcgctctcgccctctctctctctctgtctctctctctctctctctctctctctctctctctctctctnctcttctctcagccttntagatcttttccccgcccccgccccgttttttttttccctttttgggggagttaaacccacggaggatatttaaaccccccttttttattttttaaaacaccccttttttgcccccgggggggctccccccccaaaaaaaagaagcnccccccccccccccgta

SEQ ID NO: 261682 - DNA, 402 bp, Homo sapiens
  misc_feature (7)..(7): n is a, c, g, or t
  misc_feature (243)..(243): n is a, c, g, or t
  misc_feature (255)..(256): n is a, c, g, or t
  misc_feature (283)..(283): n is a, c, g, or t
gaacgcncgacaacgataagaaactttttttttttttctttctttctttctttctttctttttctttctttctttctttctttctcgctctcgctctctccctccctcgctcgttttctctctctctcgctcttgccctctcgctctctccctcgctcgttttctctctctctctctctctctctctctgtctctcgctctcgccctctctctctctctgtctctctctcgcagccccgtatnaagtagtaaagnntttaaaggggggggcccccgggggggnccccccccccgggccccctttttccccctttttaaaaaggagaaaaaaaaggggggggggggaaaaaaatttttttcccccccccccccaaaaaaaaaaaaggggggggcccccccttt

SEQ ID NO: 261683 - DNA, 318 bp, Homo sapiens
aagtggctctgggtgtccatgggcctcaagactgggcctggggagtgtgggtgggggaatgggagagacactgcaacctataacagtgctaaagagcttcccggagtggttgtactaatttacactatttgctggagtattttaaagctaattccagacatgaaatcatttgccttgggagtgttttttgtttgtttgttttgttgtgttttttgagacagagtcttgctctgtcacccaggctgcagtgcagagacacagtgagctgaggtcgtgccactgcactccagcctgggtaacagagcgagactctgtctg

SEQ ID NO: 261684 - DNA, 451 bp, Homo sapiens
ttgctatgtaaggtaccatattcacaggtctcggggcttaggatgtggatgttttccaagggtattattctgtctgtcacagtccttcaggtaagctcctgtggcacctctttgaaatcaagaggactttcctgcccctgttcctctctagcccatcaccgtgtttcatttccctcattccgcttcacagcctttgatgtcccctcgttcctgaattttttccacctgtctctccctatggaatggaagccccgtgcgggcaggggccttacctgtctagtttttcactgctcctggacctggcttcactactttgaatgtttcctgggcagtgaacaaactttgtgtgagactccctctcattttttccacattggcccagccctcagttacaaatgccagaacaacttctgtttctaggaaattcaattagaaggcatacctatgactt

SEQ ID NO: 261685 - DNA, 485 bp, Homo sapiens
tggtggcaggtgcctgtgatcccagctacttgggaggctgaggcaggagaattgcttgaacctgggaggcagaggatgcaatgagccaagaccacgccgctgcactccagcctggggaacagagcgagactgtgtgtcaaaaaacaaacaaacaaacaaacattttaaaagaaagaaagaaaaaagggaaaggagagcatcagagtctaagaccacacagaaaccctctctttactgcagtgctgaagccctcgtggcagccatgccctgctcacttttgggatacccatggactcagggcacgtcctaaggtgacacctgtcaccagccctatgcctgcctctgtccaccttcgcctctgctggagaccattctcagacacccctgagatgcccagaggggacctgcaacctcttcccaccccacctcccacaaggggtccctgggaaaactgggggtaacattccccccaccctcacccctac

SEQ ID NO: 261686 - DNA, 226 bp, Homo sapiens
gttggaatattaataatgatcagtttggattttttcatgccgatctgatgacacccagagcagcaactggaaggaagacaatccttggcccagtagaagatgggcagccccatcgagggctaaccaacggacagtttgcaggtttacttactaggttattaatgtcacagccaagacagaaatgagtgatttccccacacaattgtttgtgaaccgcaaggattct

SEQ ID NO: 261687 - DNA, 714 bp, Homo sapiens
gggaagactggagatacagagaggaacaaatctccatcctagctttggctacttgtacattctcacgtggtcaagcaggatctccagtgaatactggagcacacccagatgctgcaagaaactttgaagtgatttggggcatacacacaggccagatcaggaggttatgcccaaaatcagatggaaaaacctccctgtggtttgcaccctgccctcctatcctctgcaggacattcagagtaggtgcttaattaatacgttttgtatgtacactgccttccaagcttctgctcctcctctgattccaaagaggttttgagtttcttattcctcacaaagttcctggcttcaacctggcagatgcaaacgtctgtcatctctctctgtctcagatgccttggtacagaaatagagccaaatcacaaaagccctggccaggctaggtgtcacaaatatgtaatgtccttatcctgattatgttcagtttaaaaatttggggtctttcttctctagatttttctaactatatagtttctttactgaaaatgagagatacctataacaagatgtgtgcacagaaagaataggatatatgtgtagtctagaaaccctcccttaaaaatggacaaccagcagccctcagggctgttttgactatggagtaaccatttttttattcctttacttttttaataaacttgctttccctttgca

SEQ ID NO: 261688 - DNA, 663 bp, Homo sapiens
ttcacatgtattaagtcttttattcattataataaccttcaaagtggatgttacccttggttgagaaaactgaagcacagaaagtttaactaacttaactttgtcttaggactagtaagtgccagagggaaattcaaacccaggcagtccacatcagagtccaagctcttaaacactgtctatacgccctctctaaggtgtgctaaaacattctgtctggcagaacctcactggagaatattagtctctctgagtagctttagcttatccccagtataagatagggaaagagaaattcagacagggaacacatttctatgctgacttctatagtaatgaattttttgataagaaagtatttcctcaaaacccttcacctcttttaatagaggcattaccgttttgaaaacatccaaactggtgtgctttgttctctgaatatgccttagaattatctttcttgcttatcttaccggcttcctgatttttaatatgacttctcccactcttgaaaaaaaattctactttgtacttatgtagtgcttgcatttcaaagtactccttattatcactctgccgtagatttgctatcagagaaatgagggtaatgggaagtatatataggtgtatgtgtctgtgttgtgtttatactttatgctcttt

SEQ ID NO: 261689 - DNA, 501 bp, Homo sapiens
agcctaggtgtgcgacctgctggcaggatacctgggccatctcgtgcagccactggctccttcctcgctctcttggtgctccctgttcaacagaggcttttccaggcagggtgcaaacagccagagcttaatgagcttttaagattagagatgctattcgcctggggttgctgtgcagccgagactgagggtgactcatgccgaatatatactgcctagacagtgacaattcgcagcatctctcactactaaactacaaaatgttgttcccttgctctccctcaccctgggccatctgtttgtctctattactggttacacagtactgtcaggggacttctgccccctcctacatggctcacttcagggctgccactccacacattacaaacctacacatctaagacccggaaccagcccttctgttcagcagcaacatgtccacccccagctccaagctggggagcgaattaaagtgattaacaaatggtaaatggtgct

SEQ ID NO: 261690 - DNA, 260 bp, Homo sapiens
cctaaaatatcgaagatgcaattaaaaatcatttgtcacatcaaaacccaggaaattctcaacttgaatgagaaaagctaatcagaagatcatgaccctaattagatgacaaagatgttagaattatttggcaaggattctaaagcaaccatcataaaaatgcttaagaaccaagtaggaacattcttgaaacaaatgaaggaagtgggatgtctcagcaaagaaatagaagacctgaaaaagaatcaacttgaaatttt

SEQ ID NO: 261691 - DNA, 926 bp, Homo sapiens
gctgtatttcattaagctatagtgcaataaaataaaggaagaaaatgtaagagacaaagttttgccttatagtgattatccggtctccagtcttgtcattctatttatctgtatccaccctcccctaaccaactaaatgtaaacttgaagacagggatgttttatccggtttactgatgaaactagaaccgtgcatagcacatagcaagttaccagaaaatttttgttggatctttcccctaccttcctttgaaacttcttgatctctttctgctgttgatattactactctttattgagaaatgaaatcttgatgctacttttaggttctcaattatttttgcctcccattctttacatccagtaaatgaattaacttggtgagttaacttagaccagtatctggcacatattagaccctctatatattagctgtatcagcactgtcatcatgattattatcatcatcactaccatcaccttttatttagctttggcagtctctgtgtctgccttctgttccatccacttcctctctgagtgatcacttctcacccaaaattttgcatttggcttcttaaaagtctacctgtatacatatctgtgtctctctcttatcttttgtcttcagtattccttttctgctccggtgtaacttttacagtttcgcttttttttttttttttttttttttaaagacggagtctcactccattgccaggctggagggccatggcgcaatctcggctcacgcctgtaatcccagcactttgggaggctgaggcgggcggatcacctgaggtcaggagttcgagaccagcctcaacatgggaaaccccgtctctactaaaaatacaaaattagccgggcatagtggtgcatgcttgtaatctcagctactcggaggctgaggcaggagaattgct

SEQ ID NO: 261692 - DNA, 1160 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(9): n is a, c, g, or t
angncntnnacccacgcgtccgggattttttagcttgcaaaaaaaatgagcaccaaacctgatatgattcaaaagtgtttgtggcttgagatccttatgggtatattcattgctggcaccctatccctggactgtaacttactgaacgttcacctgagaagagtcacctggcaaaatctgagacatctgagtagtatgagcaattcatttcctgtagaatgtctacgagaaaacatagcttttgagttgccccaagagtttctgcaatacacccaacctatgaagagggacatcaagaaggccttctatgaaatgtccctacaggccttcaacatcttcagccaacacaccttcaaatattggaaagagagacacctcaaacaaatccaaataggacttgatcagcaagcagagtacctgaaccaatgcttggaggaagacgagaatgaaaatgaagacatgaaagaaatgaaagagaatgagatgaaaccctcagaagccagggtcccccagctgagcagcctggaactgaggagatatttccacaggatagacaatttcctgaaagaaaagaaatacagtgactgtgcctgggagattgtccgagtggaaatcagaagatgtttgtattacttttacaaatttacagctctattcaggaggaaataagaatcatctaccttcaagcaagaattaacagagattgtggctacgcaaatgcaccaaaaaagggtgaaatatatctgaaatgtacctggttctgcccttggaagccacttcctgctcatgccactaacagcatgctgccaaactgttcagattcaagattattccaagcgcagggcccaaatgttatagccaaagaaagtcttatgataaaagtgaggcaaatttcagccaagaagttagaagagatgtttaaaagaacaagaacaaattgtggatcatggtatatgcaggctatcagcagaaggatcagacaataaaatgagttagtgcaaaccatttagtaaaaataactatcagcagagttgttccagattaaaaatagtactacaagcttgtaaaggagttaggacatgcaagctactgagcataaaatatatacttgctatttttcatgactttctctaataaagtctttgactgttctctctaat

SEQ ID NO: 261693 - DNA, 747 bp, Homo sapiens
  misc_feature (1)..(1): n is a, c, g, or t
  misc_feature (17)..(17): n is a, c, g, or t
  misc_feature (29)..(29): n is a, c, g, or t
nctccgaaggttgaggntatagaaccagnggatccttttggctgcaggaattcggctcgaggctaatgcttgagactgagcaatttataaaagaaagaggtttaattgactcacagtttctcatgactggggagtccttaggaaacttaaaattatggtggaagccaatggggaagcaggcaccttcttcagatggcagcaggaaagagaaaaagaaggggaaactgccatttataaaaccatcagatctcaagaaaattcactcactatcatgaaaacagcatgggggaaactgccccatgatccaatcacctctcactaggtccttccctcaatacctaaggattacaatttggattacaattcaagatgagatttggttggggacacagagccaaaccatatgattccactgctggcccctctcaaatctcatgtcctcacatttcaaaacacaattatgccttcccaacagtctaccaaattcttaactcattccagcattaactcaaaagtccaagtccaaagtttcatatcagacaagttccttctgcctatgagcctgtaaaataaaaaataagttagttacatccaagatacaatggtggtacggacattagttacatccaagatataatggtgatatggacatcgagtgaatgttcccattttaaataggagaaattagccaaatataaggggctacaggccccaggcaagtccaaaacccagctgggaagtcataaa

SEQ ID NO: 261694 - DNA, 974 bp, Homo sapiens
gcgtgtgcaaaaccacaggatttattgtgcatgcatagttcagaatacaggaacgtgtatgggagtgagggccggtcccatcgagtggggcctgtaccctgcaagtgaggcccatataccctgaatggtgtcttgctcacaggtggtgcctgggcccccctatttgatactgagacccatatactgtgaatgaggccagtatcccgagtaagtcctggtcctacgctgcaaggccagtgccctttgatttaggcctatataatcctgaattccacctggcccctggaagggggaattgtaacccccagtgatgccggtaccctctggaaggaggcctctatcccctgaatgaggtcgggtatccttgagtgatttctggccctctgtggtttcggccttgttttttgctggttaatgaaagtggtgcttccaggccccaagtccttgtcatcgggacctttaagaaaagcgtctcaggccacagcgacgcagaccccagctcaaggctgcaccgttgccatggagacggttgggcgggggacaggggagggtgtgcggctccctctgcgcaggcgcacgcgcgagcagccgcgtcgcagcggaactgctgagattcaggcccagggtgcgcgctcagacgcggcgcgagcgccaggcaagctgcggctgctacctcccacgcctctccaggtgcactcggcgccgcccccctgcacctggctgcggtgccgagtcactcaggcctgtgtcagggagagagggagggagctgtcctggaaagcagacactgacagtgaggggtggctggactggtccagatgaaggctgatttggagtcaaatctctggttttctggggcgtttgaaaccataccccagaggcatcaactggctacctcaggggaactggccctgcaggctccatttgaaacccccttgatttgaaaatattgacgcctctgttcgcatctcatc

SEQ ID NO: 261695 - DNA, 234 bp, Homo sapiens
ctttccacgtgccactcccctctcttccggatcattgcagctctccccaccagccttatcaatgtggggctccaaccctacaggtcagtgattcagtcccaggttggagccactgccacgagccttttctgcacagacgggaatgtttcctctgccttgtgagcgcagggctatcgggcactggaaatatgcctgatgtgatgaggtactggagattacatttgaaaattaatt

SEQ ID NO: 261696 - DNA, 92 bp, Homo sapiens
taccaaatatatttctcataaacaggcttatatgtttatctaacattaatatagtaaggaacgaaggtgatgtaatgcttcagaaccaagag

SEQ ID NO: 261697 - DNA, 414 bp, Homo sapiens
ggattacaggcatgagccatcgagcctggcccaaagattgttttttgttttgttttgttttttgagatggagtctcgctgtgtcacccaggctggagtggcacgatcttggctcactgcagcctccgcctcccaggttcaagtgattctcttgcctcagcctcccgggtagctggcattacaggcaggccctactgcgcctggctagtttttgtattagagacgaagtttcaccgtgtttgtcaggctggactcaaactcctgacctcaagtgatcctgagcctcagcctcctaaagtccttcgattacaggcatgagccaccacgcccggcccaaagattggttttattgcatttgttaaactgtgggataggtacttgggtatttcattattgttcttttttttttttaagt

SEQ ID NO: 261698 - DNA, 471 bp, Homo sapiens
agtggagacttgcaagatccataggggtatttcctgtggctttctcttcaccttgtagcaaatctctagcaacctggacagtagattcaaatttttctctttatcaattaacatggaataaaaagaccaagaataggaacctttggtgccaaaaatcaaaagggaggaaaatatgttttatttgatttaaagataaagtcctattgctttaaaataagtcagaagaaataaaagttgaggttctcatagaaaccaactcctcctccttgctcagacgtagcatttgtgcctgttagatgctgtctgcacagtgccactgtgttacataaaagcttgagccatgtaggagctttcttgtcattcagaacactgcagctctagcttttgacctcagatactttgttttctgtgaatttgttaatgaaggtatgaggttgttgttttggtatggataataaagagaaacccagg

SEQ ID NO: 261699 - DNA, 423 bp, Homo sapiens
cagaaggcagttggaacacagggagctcattcattgcaacaaaagttgaacacctactatgtgctcattacaagaggaacttcaatgaagaagggagaggtctgccttcctgggcctggggtctggtgggggagattgtcagtgataaacctaaggtgcactgtgactggggacatgacatactaaagtggtggcatttcacatgcgtccggaaaaacaggtagaattctgagaggggacaccagaggaggtggatattccaggtagaggaaaaaactcagttggtttctccctaatagaggaaaggtctttccgataacatgagctgtccctagacaaggtgggttgtcttgtgaaggagtgagttttggtggcatttacataaagaatagaagaccacatgttaaagggactgccattctg

SEQ ID NO: 261700 - DNA, 542 bp, Homo sapiens
ctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcatccatcaacccatcacctaggtattaagtccctcatgcattagctgtttgtcctgatgctctccctgtgtccatgtgtactcattgttcagctcccacttatgagtgagaacatgcagtgaaaaacaaagtttaaaaaaagaaaaaagatatagagatgttaaactagttgggccagcttggaaacaaatctagaa

SEQ ID NO: 261701 - DNA, 580 bp, Homo sapiens
ctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcatccatcaacccatcacctaggtattaagtccctcatgcattagctgtttgtcctgatgctctccctgccccaccaacaagccccggtgtgttgttcccctccctgtgtccatgtgtactcattgttcagctcccacttatgagtgagaacatgcagtgaaaaacaaagtttaaaaaaagaaaaaagatatagagatgttaaactagttgggccagcttggaaacaaatctagaa

SEQ ID NO: 261702 - DNA, 930 bp, Homo sapiens
ctgcattatctcttgacattcttcccattatacctctggatcttagcacagatagttatcatttctctgtcatgggtttgcaaagcctgttatcctattgagatcacaatcacttattaaatcgttcacagattgactccctcagtaagtgatactaactttactccagaatagacctaatatttatatacccttgatctccctgcttctacttctcttgtcctcatagtctgattttcacacagcagccagagggatcctttcaaaacaggtcagttaatttttttgttaatggccagatatggtttttattgtaaccactcaactctgccattgtaatgcaaaaacagccatagaccatatgtaaatgaacaggtatggcacttataataaaacttaatatataaaaacagagccaggtacagtggctcacgcctgtaatctcagcactttgggaggctgaggcaggtgaatcacctgaggtcaggaattcaagaccagcctcgccaacatggcaaaaccccgtctctataaaaataaaaaataaaaaaaattataaatacaaaaatacaaaaattagctggacgtgatggtgcacacctgtaatcccagctacttgggaggctgaggcaggagagtcactttaacttgggaggtagaggttgcagtgagccaaaattgcgccactacactccagcctgggtgacagattgagactctgtctcaaacaaaaccaaaatcaggcagtgggctgtatttgcctatgggctatagtctgctaccacctttttaaaacacaaattagataccaccccctcttaaaattctcagggactccctattgctcttaaagtaaaacccagacttcttactctggccttcaaggtcctacatgacatacattctgccaacctctgacttccactcagt

SEQ ID NO: 261703 - DNA, 2070 bp, Homo sapiens
  misc_feature (286)..(286): n is a, c, g, or t
  misc_feature (304)..(304): n is a, c, g, or t
  misc_feature (398)..(398): n is a, c, g, or t
  misc_feature (425)..(425): n is a, c, g, or t
  misc_feature (528)..(528): n is a, c, g, or t
  misc_feature (540)..(540): n is a, c, g, or t
  misc_feature (675)..(675): n is a, c, g, or t
  misc_feature (684)..(684): n is a, c, g, or t
  misc_feature (688)..(688): n is a, c, g, or t
  misc_feature (816)..(816): n is a, c, g, or t
  misc_feature (1029)..(1029): n is a, c, g, or t
  misc_feature (1055)..(1055): n is a, c, g, or t
  misc_feature (1080)..(1080): n is a, c, g, or t
  misc_feature (1151)..(1151): n is a, c, g, or t
  misc_feature (1375)..(1376): n is a, c, g, or t
  misc_feature (1384)..(1384): n is a, c, g, or t
  misc_feature (1417)..(1417): n is a, c, g, or t
  misc_feature (1646)..(1646): n is a, c, g, or t
  misc_feature (1766)..(1766): n is a, c, g, or t
  misc_feature (1846)..(1846): n is a, c, g, or t
  misc_feature (1961)..(1961): n is a, c, g, or t
ggcaggaaagaagagtcacatcacgtaggtgatgggcctagagatatttcacaatgccttctgtaattagaacccagaaaaaagagttatatcatttgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggctcaggtatctgcagatttatggctaaaagaccnggaccccctggaagccgngaaatgggactgttgacattcagagacatagctatagaattctctctggaggaatggcaatgcctggattgtgctcagcggaatttatataganatgtgatgttagagaactacagaaacntggtctccctgggtattgctgtctctaagccagacttgatcacctgtctggagcaaaataaagagtcccagaatataaagagaaatgagatggtagccaaacncccagttacgcnttcccatttcacccaagaccttcagccagagcagggcatcaaagattcactccaaaaagtaataccaagaacatatggaaaatgtggacatgagaaattacaatttaaaaaatgctgtaaaagtgtgggtgaatntgaggtgcncaangaggttatagtgaagttaaccaatgtttgtcaactacccaaaacaaaatatttcagactcataaatatgtcaaagtctttggtaaattttcaaattccaatagagataaaacaagatatactggaaanaaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtcngcaaaccttactagacataagagaantcatactggagagaaaccctacacntgtgaagaatgtggccaagcctttaggcgctcctcagcacttactaaccacaagagaattcatactggagngagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttactagacataagagaattcatactagagaaaaccctatgcctgtgaagaatgtggccaagcctttagcttatcctcgaaccttannagacatangagaattcatactggagagaaaccctacacatntgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcanactggagagagaccctacacatgtgaagaatgtggcaaagcctttaattgctcctcaacccttatgcaacataagagaattcatactggagagaaaccctacaaatgtgaagaatgtgancaagcttttaagtggcattcaagtcttgctaaacataagataattcacactggagagaaaccctacaaatgtgaataatntggcaaagtccaccctcaggccttataatacataaaataatttacactggaaaaaaacactacaaatgtagagaatgtggccaagcctttaaccagttccaaaccttaattgaangtaagagaattcatattggacagaaattttataaatgtaaaaaaatgtaacaaagcctttaaccaaccctcaaaccttaataaacctaagagaatttattttaaaaaaa

SEQ ID NO: 261704 - DNA, 673 bp, Homo sapiens
cagcagagaatatgaagactatatagcaaaatagaggtcaaggaagtaggaggagaattaagacaagtgaatgagtttcaagaaagggtatatagtctaaaagtagtctgagaacaagaaacagccctctccatctccagtttccgcatctccagtttctggcaaccactctcttccttagctccctaaagcctaggaatgctaatggagcacattttatgctggttctacacacgtctttatgatagcacccctacaccctgtccacacctttgtaaatattctctttatcaaattatcccagtttgagtatatcattgattcctgctggaacccatataatgaagttatattttaccctatggtgagtatggggagacacataggaattgtaagaaagagagatactgatcagatttgcttttcagaaagattattggtgatgattcgaagaatagattagagaggtgtaatactggaagcaaggagaagaagaagtaggaaacttgcacaaggaccaaagaagatacaggcttaaaatgggctgggaggagtagagagggatttaaattttagtgatgttaaaaaaaaagaattctagcactcagtcactgagtgttagggttgatgaaggaagaattgagaatgtctcctaagcttatgacttgagtga

SEQ ID NO: 261705 - DNA, 415 bp, Homo sapiens
ccacaggcagctgtttcaacaggacccctctgcaagactccttcaaccacatgacgccttcactgctgtctgcccagacaacttcattgtgtccaccagaagtcagtatgacgcaacttcccagatcacactgtgaaagctgccgaggagctgagactttgcctgtcctcccttcaagacagtgcacgccatagtgcctgctgggtcctcgcatctgcccctgcaatccatccctcctcctgaccaccatggcccatcctctgtattatccttgtggcatgagcccacaccgctgggacgtgagatctgttgaatacatttatctttgtgtgtatagccccatttaggcgctgtggggcaggaactaaatgaggtatcttttggcatctcaaaataaaacccaacaccttggata

SEQ ID NO: 261706 - DNA, 360 bp, Homo sapiens
gcaatcacacttccatccccacagctcctctgtccacaggcactgtagtctgtgccctcatgtcttctgggagacatagtgggaaggtaacccccacaccagtgacactatggggaaagagacactgtgggactttgccctgatttctcaggggccttttctcttttccgtttgggttacatgtagacttccctactgtccacctgaccactctcgtgctgcccaaaaccatagcttaagtcaccacctaggcctttcttggtgtaactattgaaaggtgagccttatctgttcaatctctatagagattcatccaaaatctggacctacaagaataaaaaaacaagattttcctgaata

SEQ ID NO: 261707 - DNA, 443 bp, Homo sapiens
ttataactgatagcctgcaagaaaggttcagatgtgccttctaagtcatcatatagggagggtcagtagatgcttcctcagatgtctgcatggcctgcttcctcctttcctttagctctttgttcaaatgtcaccttgttaaaggttttctcagaggactatgaaaatggctttctggcttgcctgtcccttacccctcacattccacatcccatttctgctctatttttctttgcagcacttatccccaactcatataatatctacttttcccatttatttgtgtattatatcttgcacagaaacgcacgcatgtacatacacaaacacttgattgtaagttccatgagagcaaaatttttcttttgtctactattgtgtcccagtggctagaaaaatatctggtacatactaagcactcaataaatatttgtacagcacat

SEQ ID NO: 261708 - DNA, 510 bp, Homo sapiens
caaggcaagcctagttaagtaaatatcacacaaatagacgtgacgggactcagttccaggtggctgtagtgccagagcttgtgatctttctagcacccacactgactctcacaaaggaagtgagggcggcttgctcctcagccagggaggaagccagattgcctgtattaaagcatgtggttttgtgaggtgcttggatggtgcttggttagatcagagcttccaacctcagcactgtggacatttgggctgggatcattctgctatcggtggcgctgccttgtccattgcagatgttgagcagcatccctggtctctacccattagatgccagtggcacccccctgcccttcaagtcatgaaaatatgaaacgactgcagaccctggtggagaacagggctagattgatgagactcttgaaagctcttaaatggagtaaacattgcattatgtcagaaatgtagagttctttgcagatttgaagcagttaagcactgttcagaaaggtg

SEQ ID NO: 261709 - DNA, 190 bp, Homo sapiens
cttaaaaataatacaaaaaaattaaaataattttattgttttgttttgaatattttagatgataaagttaaattcactaagagatactaatgaaatttaaaatagataacaattcatttgaaatgacaggaattctcttaaaattaaaacaaaattccagaagcatttttttcaaagcattcctggttat

SEQ ID NO: 261710 - DNA, 495 bp, Homo sapiens
ttggtgctgcagcaagtcaggggcgttcacggtggcctttggctaacagccttgacagcacctctgggctgctgggaagtagccggtcacctcacctagaagagggtgaaggctggagcaacagaactgctttgggactaggtggagtttggaatccctctccacagtggctcagggcctctgtgctccagcggggtttgctgtcatcatgggaatgtagaggagaaaaaccagtatcagctcgagttcagcactgcggcagggtagggacagtggttttatttttatttgagatggagcctcactctgtcactcaggctggagtgcagtggtgcaatctcagctgactgcaacctccacctcccaggtccaagcaattttcatgcctcagcctccttagtagctgggactatagacgtgcaccaccatgcccggctagtggtttgtatttttagtagagaccagcctgggcaacttatgaagaccctgttgcca

SEQ ID NO: 261711 - DNA, 395 bp, Homo sapiens
cacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacac

SEQ ID NO: 261712 - DNA, 422 bp, Homo sapiens
agcacatagagaaagagaggaggggtgtcagctgcctgccatagctgatggcaagaaaacatcatttataccaggaattggaacagagttagtttctctgtattgagttacccatttttcaagccatatgttagtaagtgaaggattttcagcttttcagcctaagatcccaggttagagaacaatgattcccaagcacaatcgaaaactacacacaatacttacccttctcttaaaattcaatagttttagtccccactttatgtttcataatgaagtgaaacagaggcactatgcatgtcttaaaatgtatacaaactggtatcaactttataaaatatattcctgtgtaataacatttcataaatcttgggtaaattttatctctaaaaatgtaaagtttgggacttacacatggtgtt

SEQ ID NO: 261713 - DNA, 665 bp, Homo sapiens
aattgcagctatctttgcaatttgtcacacatatcacgaaggaatggggaacatggacactgacagcaggacggtagccttctctgtagccactcacatgacaaaatattggccttacagttcccattctgggaaaatgaagaacccagatggttagtaatgattgtagtgattagaacaatggttttggggcatagtccacagtaggaaaaatgcaaaacactacattgatttgtggggccagagagagaagggtgccctgatgaggcagaagctcccagagagagaatggctgtaatgtaaggccagacaagtagcccacagatagataacagaaattcctagttaccagccaaccacagcaagcaatggaatgagttctgtgccttcaggtatggcagggaaccagcagagagcctgagtcatcaagcctaaatgaagctctgtggataagagtgacagccatcttgaagcctcttggatggattcaccgctagggacacagagacttcccctgcccttgtcaccccaacacttcagcaccaagtaagtcaccccaccaacataaacatagtaacaagtatggaaggtaagggagaagagatatcctgaggttatatttttgaaatcccaggagaatataagctcaaaaagaaaaaaaagaa

SEQ ID NO: 261714 - DNA, 383 bp, Homo sapiens
cccggccgcgcgatacggctgcgagagacgacgaagggcccctcacaagagcaatctccttacgcctgctggtgagtgctcccaagcacctggctactagcccagaggaaagtgggtcacttcacagatcttccatttcataaaaataaccatcagaattctgacataaggcatgttttaagggaatgtgtgagttatagcagatacctttcatgtaacattttaaaatattcaattgtaataattcaattcaaaaaaatatttcaggtcaggcacagaggctcttgcctaaaatcccattgctttgggaggcctaggcaggaggatggtttggggccaggagttcgaaatgagcctgggcaacacagcaagaccccatctcc

SEQ ID NO: 261715 - DNA, 232 bp, Homo sapiens
ggctccatctctgcctctgccctaaaaaagcctcggctgggggcagaacacatcctgcccgcacacattaactcaggcttgccttcgtgccttgctgccctagtgttgggacaccctcatctgctccaccaggccaaagcctgcccactccacaggaacccctccccaccccctggcacccaggagcacccattcaggcactggctcactcctcccatctcctgaattgccc

SEQ ID NO: 261716 - DNA, 407 bp, Homo sapiens
gaggtcatttctggaatcaagaaactgacagtctggtggaggaacagacagtttagtatatcataggttaagtctccctagtgagcaggttctgagtaatttggaagtagaggaatggtacctaacaaactggcacaggggcagcacctgcctggcatcggatgggcctctctctagcctttccatggtggccatttttaatggatcacagcacccttgtcacggggcctgaaaggagtgcagatgcaggtccttctccacacagtgctccagcaaccactacctcgtcccccggagttagccctagaagaaattggttttctatttctgatctcccactcagtctcctaagagagcaagtctatgatggaaacttgggagagatggagaagaggggcatgtaagga

SEQ ID NO: 261717 - DNA, 248 bp, Homo sapiens
gaagagcccatgcagcaggcagacttctaaagtgacccccaatggcccacatccttgtacaatacttaccccttgagtgtaggagcaataggaagggtatctcttctgtaactagatcagttatacatcaaaggtgaaaagattttgaaaatgtaattaagggccctaattaattgactttgaggtagtctaagagagattatcctgagtgagtctgatataatcaggcgagccatttaaaacaggtg

SEQ ID NO: 261718 - DNA, 464 bp, Homo sapiens
tccttcaagttcctgtactgcagagggctaacctggtactacctaaactaataattgtgaatcaccctctcacaaaataattgttttcctgaaacaatgaaagtctgaaccttaaagtttgagaacagcagcaataaaaattgtaattaagtttaaccagtgccagctagtatactatacgctgaatgtttacgccccaccctcagttccataggttgaaaccttatccccaggatgatggtatcaaggtagggccttttggaagcaattaggccatgagagcagagccctcttgaatgagatcagtgcccttgtagaagagaccccaagcagctcccttgtcccttctaccatgtgaggttacagcaagaacaccgcagtctgtgaacctggaagagggccctcaccagatcccaaatctgccagtgccttcatcttggaaatctcagtctccaaaactggga

SEQ ID NO: 261719 - DNA, 771 bp, Homo sapiens
accctcctccccaccacccagcctcctgcaccagagtcatttcaagcttctggtttttattctattgggaatgagatttctttcatttccttgtttaggccctgaaggataagttttcctcttattttcttgtgcccttagccatatatttaatagggaagaaggtaagttcctctcttgtttcataattttctatgtagataacaactaaagggaacacagagcataaaagttttgaggttgtatttatttcaatatggaagtcttgttttccagatctgcagcgtccaagagaaccttctgaatgatgggaatgttttctactctgtccagtgtggcagacccttgccacatgtagctattgagcatttgaaatgtggctgatatgtctgataaactaattcttaaatattatttaattgtaattaatttaattaaaatggtcagatacaattagtggttattgtatttgacaacacagttctaagtggtaatattctttgtcccctaggtgggtttatgtactggtaaaccagtgttgtcttgaaaatctgatatttttgaggatgtaaatatatttgaggattaaatatttgagatgtgacttcagaatatatgtcaccacaggctgggcatggtggctcacacctgtaatctcagccctttgggaagctgaggcaggagggtcacctgaggccaggagttggagaccagcctgggcaacacagcaagactctgtctctctgtttaaaaaaaaaaattagcctgaca

SEQ ID NO: 261720 - DNA, 528 bp, Homo sapiens
acacacacgctttcacaatatgactttgctgccaattccatcaaaaggttcaatctgtttctccatgtccctagatcaaagctggtttgacaacttcctctaaccaacagtcaggtgaagacaaaacatggatttctgaacctagattgccaaagatcaagactaccacaaggagaaatatcttcctgccacaggcatatgagaggataagaaactctccctatcaaggcctcacagacaaaccagttaacagacatcaccaactgtcagacataggagcaaggccatcttagacgacccaattacaatcaggcctgcaggtgactgcagaagcatgagacacaccaagagaaatcagtgaagaactctcgctgagttccactcaaacccctaacccaaagaattgtaataaatggttgttgttttaagccattaagtataagggttgtttcttaattagctttttttttttttttttttgagatgaagtctcgctttgttgcccaagcggtgtgcattggcgtgatc

SEQ ID NO: 261721 - DNA, 663 bp, Homo sapiens
ctccctgttggtggtggtggtgacggagcggtaggagggaggctagcagcgagagcttctcctgccgggctggaagacagaaagaagaggcaccgccgcgtgctggaggctggagccggagcttgcgcctccgcggctcgcctcgctgcggttggtggtgaaatcagagaccgcagctcggccacagtggtagaaatgtggtagggtagatcaaagctggtttgacaacttcctctaaccaacagtcaggtgaagacaaaacatggatttctgaacctagattgccaaagatcaagactaccacaaggagaaatatcttcctgccacaggcatatgagaggataagaaactctccctatcaaggcctcacagacaaaccagttaacagacatcaccaactgtcagacataggagcaaggccatcttagacgacccaattacaatcaggcctgcaggtgactgcagaagcatgagacacaccaagagaaatcagtgaagaactctcgctgagttccactcaaacccctaacccaaagaattgtaataaatggttgttgttttaagccattaagtataagggttgtttcttaattagctttttttttttttttttttgagatgaagtctcgctttgttgcccaagcggtgtgcattggcgtgatc

SEQ ID NO: 261722 - DNA, 461 bp, Homo sapiens
ctccctgttggtggtggtggtgacggagcggtaggagggaggctagcagcgagagcttctcctgccgggctggaagacagaaagaagaggcaccgccgcgtgctggaggctggagccggagcttgcgcctccgcggctcgcctcgctgcggttggtggtgaaatcagagaccgcagctcggccacagtggtagaaatgtggtagggtaggtttctctggctttgcctgcgcaactgctcccagccaggctggaggaggaggaggagtcacctgtggtatgctggagcctgtagatggcgtggctctgcagcttgcctcatgagtcatgtgaagatgcctgctctggctctgccttccatcatcatgagtaaaagctccctgaggcctccccagaagcagaagcctctatgcctcctttatagcctgcagaactgtgagacaattaaacctcttttctttat

SEQ ID NO: 261723 - DNA, 387 bp, Homo sapiens
ctccctgttggtggtggtggtgacggagcggtaggagggaggctagcagcgagagcttctcctgccgggctggaagacagaaagaagaggcaccgccgcgtgctggaggctggagccggagcttgcgcctccgcggctcgcctcgctgcggttggtggtgaaatcagagaccgcagctcggccacagtggtagaaatgtggtagggtaggtttctctggctttgcctgcgcaactgctcccagccaggctggaggaggaggaggagtcacctgtggtatgctggagcctgtagatggcgtggctctgcagcttgcctcatgaggtttagaaaaagtttgtcatctcagctactgacatttgaactctacctgcctgtactgaagaaa

SEQ ID NO: 261724 - DNA, 488 bp, Homo sapiens
agttctaatcaatagtttaataggtagtaaaatacagagtacaaataatgtgtagaaatccagatactgcgatgcccctactttgtgttcatgataggaatttgttttttgcagaaaatttaaaaatacatgtgttcaacaaaccaatttaatcaaaatgcaacaactgatgatttagggaatgataaacatatgtagtattgggaaaataagtcagatgcttatttgcagctgttttctgaggtttccattacatctaatggaataataatctattgtatctaacggaataataatctattccattgacatgaaattttatgtctactttcctcctcattctatcatttttccttcttaaatgtaaaacttcaataggttataaataactagcatccagtaaaagtccacccacaaaaacattcatttttgtagcctaagaatattgtttggaaaatggtttctaactgaaggaaaaagctaccaga

SEQ ID NO: 261725 - DNA, 638 bp, Homo sapiens
gactgggaagatggaaattaaacattgagaactcaggtattctgacaagttttttgagtgagcatcatctggacaactaggtcttcatcatgggaagatctagattatcagagagccttgatcattgaagaaacaacaaatgataagtgtggctgttatgcaaagagagaagcaggaaggaccaggtgtgttcagggaggccagcatgggtgtgacctcaacagaggatgcagcaagaaggattcattttggaagcagatagcagtcctcaccagaaaatccaatctgatggcatcttgatcttgacttcctaccctccagaactctgaaaaagctgtagatcatgggatttaataaaggaactatgacagtgtaaaatagagactccatcatatcttggtcatcagcccgttgggatgcagagcccacatacatgaaggcgaggggcccatagtataaagatacagtgaagggacctgatctaggatggccaatgaaacacgctgatcctacattcggaatatggagagaaagagaaaggttttggtttcaaaagcagcctgtgtactctttatatctaaaataaaagttgaaatgcaaaacattttaagaagcatattaaaagtttatgaaggcaa

SEQ ID NO: 261726 - DNA, 288 bp, Homo sapiens
caaccaaaaagaataggaaaaaaatatagcccaaatgtagaaaaaaagcatactatagtgatatgtcccaagaaccatacaaatattgttatgcttctagattctgcgatgtatgcagtagttagccaggatttgcagtcttggtgatttgatcacaaaatacagacatcgacaacaataacatgaaccctactactaggattagttactactagggttagtgcctactaacatgtagccactactacaaggacatcaaccaaaaagaataggaaaaaaatatagccc

SEQ ID NO: 261727 - DNA, 478 bp, Homo sapiens
acgtttaaagcagaacttctttgttctgtggcataggttgtacactgtaaaacataggttgtaccaggttgaggaaacaaaagtctttctctaatttgtccaccagtagtatgcatctttttctccactagccaggggctatggaggccctgaatagaacagaagagcagctagcaagggcggaaggaagagagagaagggaagcacagcgtgggatagactgggaggccatgaggactgttaagggctctaggttttgttccaaaagataaggcaagccactggagagttttgagcagaagaatgttacaatccaattcacatttgtaaaagagccctctggctgctggggagactagctggtagatatggacacacacctgccatcccccaccctcattctctttggagttaacccccttctacacctgccctctactttctgtaacatataggcaccccctgctccacactctat

SEQ ID NO: 261728 - DNA, 636 bp, Homo sapiens
ctaaggagcagatagaataaaaattttacctgagactgcacagttagggagtgcgacagcttggatttatgttcagtacatcatgctccagagcctgggaaactgtcaaggctctgttgttaggtgaaagaagcaactacacaagcatgcatattttaggagctcattaaaagtaatacttcacaggttaatacatttacacaaaaaactggacctggtgacaaataggtggattgcaaccttggtaagatcatgttcattgcaatcctggcgacagaagccacagtgcagggggaagtgaagaattttaacaggaaatgtagaaaactctctttggtagtttaactttgaagggaaagagatggagattctggctgaatggggagattttaaaaaataatcaatttcttgaaacttgagaaggttttaaaatgaagatacttaggggttttgctaaatgagaagattttagctgttcttgccatgcacaaaaaaatgggtaactatgtggtattatgaatatatttattttcttcactatatagtaactaatactttactttctgtatgtatcttagaacatcatattgcatatcttaaatatagacaataaatgtatttttaaaagttaaaaaa

SEQ ID NO: 261729 - DNA, 416 bp, Homo sapiens
aatcaggatcccaaaaacatattggcactcccatgtttatttcatttcagcactattaataatagccaagatggaaaaactacctgctcattgactgtttaatggattaaaaatgtgatagacacataatgatatactattcagccttaaaacggaaagagacctagcaatatatttcaacatggtcgaatcttgaggacattaagctaagtgaaaatagccagggacagaaagacaaaaactgcattgttccacttacatggggtatctaaaatagtcaaattcacagaatcaaaaagtagcacaatagtgcttgccaagggcttggggcaaaggaaatggggagttgagttacttatctaaaggcataaagtttcagttaagtaagataattaagctctaataatctgatgtac

SEQ ID NO: 261730 - DNA, 501 bp, Homo sapiens
taaagatatgacatgaaagattaatagattcttcccttctactaaaagtaaaagatttagaacaaatcacaattaaggccagttggcagtagtcaattgggatagtttcttcatgacaggatctatattttttctatgaatcaggtatttgctgacagtgatttgaataattactctaggaatggggagagagaatggtctcggaagtataagaaaattgccggagaatgctggtgttccatttaaagactagaaaaataaattcatagaggcactgttctgcagaggcataggctttcctcaagtatggagaaggaaattgtgtgattagtccagagttgggacatgaagccccagagtagaataggtcattctgtcaacactgaaacccaagtggaacttccatggaaagtaatactataagccagcaagaaagtttttagtatataaggggcaaagaaaggaataatagaaatagatataagaatttaatgcaaattg

SEQ ID NO: 261731 - DNA, 488 bp, Homo sapiens
ctagtcctatgcattccaatccaacgttttacagactcaagtctagccaggatggatttgttaggatggcctcttttttgccaggatgggctgaggattataaagtgtggttaagagtttcaaggtcaaacctagtacttcctatgaaaataaaagatagcagtacattacgttgtcaagttaatacagtatgatggagcatctccagactgcagatcctggacgactgtaaaagtctaacagatttagggaaactgtacctcagggagcacattagacagcactcatcaatggatcaaaactgtcttggaggctcccttcccagggagcagcagaacccctgaaaatgatggctttcccttcaacaacctggagataaattgtacttcatgtattacatgtacattcatgtacgaatggggtgcttagtgcgagtggaaaatgcaccttattttaccccaaatgaaaaagtatatccttttcatttt

SEQ ID NO: 261732 - DNA, 472 bp, Homo sapiens
tggcaaggcggatcctttaactgtaccattgttgctagttcacttctggtcagaggctgtgagttttcctccaggtattggcgtctggtgtctctgtgtccacacatgcattcttgtccaaggacgctagcagatgcttgactctgtctctctgtaaacacatacacagttcacatatttttagaataaagtctttcttcaatgcatccttttccttatccttaacgagagtgtgtctcatgaagggtctcactggatctttttcttccctttatttccaatgctaattaaaccaaaatcttctgaaatagccttcatttcacactgtcagcccactggtatggaatcggttgcatattaacaactgtctagacaggttagagaagggaatctgttgatttagtcagcctgcccaaggcagcccttgtttgtgactaactgttaagcagtgttagaagggaagaaagttggc

SEQ ID NO: 261733 - DNA, 416 bp, Homo sapiens
ccacagctggcccgcatgctggggaggaggcgcacaggcttctcccaccccttccctgcacctctgataaaccctcagggaaatcaccctgtgatcccttcaggctaacagaagaaaatctatatgaaaaagagaaggcagaaagctgaagtgataatgtttagaatccttagaagctggaattcccatctaaagacaaggcgatttaaaggtgtagacagtgattgggcttcagtgctgaacaaagacatctaaaactcaggactgataagacaaaatggacagaaaactccatgaagatgcaataaggagacctagctcaaaacattttttggactctggagctctgaaaaggggtattttctgccaagttatctatcctcagacaaaagtaaatgttttgacattcctgcagg

SEQ ID NO: 261734 - DNA, 673 bp, Homo sapiens
ggaaactaagagaacatgtggaatgtgatggatggcagcagtttgaggggcttcttgggaatctctcttctcgctgaacccctgatcctgtaatgggtggaagtagaacaatgacaaaccactcctttgatgcctagctacagatcactaaaggattatttaggactttgactatcagcaggctgctgaggtctagacaagaacctgctcatgggcaccattaaatgagtcattttattaaataaaacaaagcccatgtaaaaattaaggacatgtgttatttgtgttagctcccgagacctaaagttataatgcattttgataggaaagtaatattttgcaatccaagataactgtttacctcttttgtgtgactcagcagtggataaaatgatactacacaaactaaacaaaccaacaaaaaaagccagtaacaacaacaaacaactgtaaccactgcagaatttcagtttagtacctgaagaagattttatacttccagaattagactattctctttcttaagctataaatgacacacagactgggcctaagctatatttatgtacacttaggcctaataattaatggctttctttatttgggttccattctaccacatcatatatcgcatcttcactcctccatcattaccttcatatctgaccagtct

SEQ ID NO: 261735 - DNA, 449 bp, Homo sapiens
tctcagcccatccactcctgcccactctacccactcccaccacactacctttagaccttgtcttgaaagtctaaagttggcagacggtgggcccaaagtggcccgtaggtgtattttgtttagctcacatggggctttttaaaagaagtccttccccctcctgcctcctccgcctctttctggaatcaggaatctggtttcgtggcttttgaaatatcagaagatctgacaacatgggctcactttccagcctggcattacaagcccctttaagagcacataaatttaccatagtccccgctaatccctgtttctcacggttagttaccttctgggtctgtgcagacatttgtgatcccctccccctcattatcccaccttccaacctggaaggccctccccgctctcttctcatagccaaaattcaagccctcttcaaccaagataag

SEQ ID NO: 261736 - DNA, 346 bp, Homo sapiens
gtcaggtcttcctctgcaagccaggcagtgtcaccacccagaagtccagggtgcctctttaggtccagagcagcagctgtggagtttcctgctttgtgccttgccatgttcaccaacatcactcaatataaattggggaaaatttcttaattactgctgggtctctctgcattgtggccatgttctgaagtccaggagagatgggctgatggccttgggatgcataaagtgacgccggccccatcagctcaggctgggggagaaaacagaggctcaggaatattctagagagcctaagcaagggcctcataggagctttggaatcccagtgtggattctgggattg

SEQ ID NO: 261737 - DNA, 555 bp, Homo sapiens
acattttgattgctcagttatataaaagcggtgttatagactcctttattctccacaaaatgttgtcttatatgtaaagtgccaaaagttgtgtttaatttcctaagaaagtcattgctttgtaaacatttgcataatacttagtgttttttgtaattttaaaaaattagcttaaccaaaagagttgcaaaattaaaacttacttgagtaggtatctttcagacaaagctgcatggcttcatgtacaatagtccccagatcacctcgcactgtagtttgctcaagaaggagcctacagatggcaggtaggagaaggtaaactggaaattaacaggtctgtctgtaagagcatgccactggaaacacccatccaatttgggacccctggaagacagcatgtgtctaatgggaggcctgtcctagtacaactcctttactcttttcaccttcatcttgaccttctcagataccatctttatgtaaaatgttgatgttgtggagtttttgcagtaatttaatttttataaatattgtattaaaatatatttatcttga

SEQ ID NO: 261738 - DNA, 1993 bp, Homo sapiens
  misc_feature (820)..(820): n is a, c, g, or t
  misc_feature (867)..(867): n is a, c, g, or t
  misc_feature (870)..(870): n is a, c, g, or t
tgaaatggagtcttgctctgtcatccagactggagtacagtggcactatctcggctcactgtaacctccgcctcctgggttcaagcaattctcctgccccagcctcccaagtagttgtgattacaggtgtgtgccaccatgcccggctaatttttgtatttctttagtagagatggggtttcaccacgttggccaggctgctctcaaactcctgacctcaggtgatccacccacctcagcctcccaaagtgctgggattatagagtggaaccgccacacctggccggtttggtaattttagaaaaaggtttggctttgaaaaagtcaagataacaggagaaacagcttctgccagaaaagaggcagtaggttcccaaactacattaagaaagttcccaaactatattaagttgttggagaaagagtatctgcctgaacaagtttttaatgcagacaaaagtgccctattctggaagaaaaaggtcacaaagatctaaggaagaaaagtgaatactaggacttaaggcaggaggagatcgtctaactttactgttttgcgcaaatgcagttgggtttatgatcagaactgccattacctataaagctgctaacccgagtcttgaagggaaaaagataaacaccagctgccagtcttttggttgtacaacaggaacgcttaaacaatatgaaccctttttcgtgatcggttacattaatgctttgtccctgaaatcagaaagtatcttgctagtaagggactgccttttaaagttgttgggttttttttttttttttgagatggagtttcactcttttcgcntaggctggagtgcagtggcgcactctccactcactgcaacctcctcntcntgggttctagcgattctcctgcctcagcctccctagtagctgggattacaggcgtactccaccatgcccaactaatttctttgtatctttagtagagacggggtttcgccctgttggccaagctggtcccaaactcctgatcgcaggtgatccgtccacctcagcctcccaaagtgctgggattacaggcacgagccacagctcctggcctaaagttgttttgatattggacaatgcccctggccacccagaacctcatgagttcagcactgaaggcgtcgaagtgataaatgcttgctcccagagaagcatctctaattcagcctctaggtcaggggtcgtaaagacctttcaggctcattacacatggtactctttggaaaagattgtcagtgctatggaagagaaccccaatagagggaacatcatatcattgaagataccattattgtttagaaaaagatgtgaaagctctcaagcctgaaacaacaaatttttgcaggagaaaactccagatgttgtgtgacttcacaggatggaaatcatgatagagattgtggatatggcaagaaaggttgggggttaaggatttcaagatagggatcttggagatattcaggagctaatagacaccaaaccagaagaattaacagaagatgacttgatggagatgactgcttccaaaccactgccagacagtgaggaagaagacatagaaaaagagaaaaagcgtgcaagaaaacagattgacactagacagtctgacagaaggggtctgattattcaagactgcttttcacttcgtttgcaacgtggaccgtttggtgatatgagaactgaaactaaagcaaatggtggaagaaggattggtaccatatggaaacaatttagagaacaaaaaagcagaaaagtcagaaattacattgtatttccataaagttacaccaagtatgcctgcctctccagcctccccttttaccttctccacctctgctaaccctgagacagcaagaccaacccctcttctacctattcaatgtaaagacaaggatgaagacttttatgatgatcgactttcacttaatgaatagtaaatatattttctcttccttgtgattttctg

SEQ ID NO: 261739 - DNA, 260 bp, Homo sapiens
atggaagttaagaaaaactggagagaaaagatttttttccttgctcagcttttttatgtctaagcattagcacttactactacttatgcctcagagacagaatgggcatcatctctgcaaaacaaaataaaacaaaacaggctcggtatggtggtgcatgtttatagtcccagctacttgggaggctgaggcaggaagatcacctgagcccaggagttcaaggccagtatggagaatgtggtgagcccccgtctctcaaa

SEQ ID NO: 261740 - DNA, 473 bp, Homo sapiens
gagcggactcttcggttctccgtggaaaatcaaccagacccaaaacagaggtcccgggtttggggataccacgccgcgcgcctgagcatccgggctccatttctccaggcgacatctgcgggaagggagacctaaaggccaaggctggggacgagagatcatccaccaaggccggggtttccgagtgaggcgcccacttcgcatcccacagtaccgccagaaacccatcggacccacaaagatcaaaatcttcggtaacacaccaaactggcgacgctgtggggaagcaagcactctcccaagtggctggcgcgcagtgagggcgcaggaaagaaaaagaaaaaaaagaaaaggcagagcggggtggctcacacctgtaatcccaacagtttaggagaccaaggagggagaagccctagcggccaggagttccagatcagcctgggcaacataacgagaccctcgtctctgca

SEQ ID NO: 261741 - DNA, 683 bp, Homo sapiens
ctcagttgaattatgtttttataaagcactatatttagagtcattgaaataaccaccataagcattaaagatagaaattgtttctgtagagaagtctttaggggagaggtgcagtggggctagggaatactgcctttcattgtatatctctcattaccgtttcatttttaatcatctgcatatatcactgcatttaaatacatttttgaatttttgtaaaaaaatttaaaaatatttgagaaaataaattgacttaagtaggcagactatttctggggattttgtagtagttcatgggagaaataatggtttttctctacagtcagtagacagccaaatgatcagttcaaacaaagtaggtgggaggacagtaatgaaaggggagaaagaataggaacaggatttttatggagcaaagggctttgatgtagccacaggttgataaataaattaaattcaaggtattgtcctacttgtgtctaacaatgatttgaggaaaagatgtgtggtctttctcagggccttaatttcagcccaaggaatagaaagctgttcaggggaagtcctcgtctgacccataccctacccctggtgcacacacttacccagctaaggagtaggacatgacagacacagctggagagtgtgcaacctcaccagagagttcttagaaaggacaagtt

SEQ ID NO: 261742 - DNA, 448 bp, Homo sapiens
aaaaaaaagtgggggagggagcacagttaagtttctcgggggtcttctgtaccataataacaaaatgtggcctgtgcaccatcttcagattttgagaagaacaaagcaactgtaaaagacatctttaaaactatttgggaaatttgaacatgtgttaggaatcaggagatattaagggatagctggtaattctgttaggcataataataggttagtggttatgttttaaaagatggaacatactaaagtgtttacaggttaaatgacatgaaaaatgggacttgctttaaaatactgcagcaaaccaagaaaacaaaaaggtggaagtagatgaaacaaaatggtaaaatgttgaaaaatgtcaaagctggatgatgggggtaccttttattgttttctctacttttttgtgtttgaaaattttcataataaaatctgtttgttttct

SEQ ID NO: 261743 - DNA, 349 bp, Homo sapiens
tccgaatttcaagggtctcgctgtgtcacccagcctggagtacagtggcatgatctgggttcactgcaacctctgcctccctggctcagaccatcctcccgcctcggcctcccaaagcgttgggattacaggcgtgagcctcgcacccggcattatttctgaaagcgaatctgaatccccagagctctggcgcctttggtcttctcacagttgttttggaattcacgcatcctcactctctgccggagccacccctcaccacacacaagacggggtttgttgtttttctcgctgcgatgccaaactataaaaccagcgtggcagggtgcctccctcagtcatctgcaaa

SEQ ID NO: 261744 - DNA, 468 bp, Homo sapiens
cttgaaacaagtttgtctcagaagaactcagatactctaactatcctgggctggaactttgtggctccaaacggtgtccagcccatacttggcactcccctgggtgtttttttttttaacggttctggccttttggatatggcacaactgctgccacctgcaaggctgccctggtgataactcccttggcccagcatgtggtgttcaggcagccacttttcccaaattgttgaatactctgcccacctcctataatgagatgctgaacagatttgagctgaagaggcagttaaacttcacacattgaatttgtaataagtcccacccgcaatcatcttaaaagcatttgtaccgatgtaattgctgtcatttcaaaaccttgaaaagacttcctccctatcctccccctgtacccctaccctgacaattcctattctttttcgtaaaggaactgtggaaatcgaggct

SEQ ID NO: 261745 - DNA, 963 bp, Homo sapiens
agggggctgaggcaggagaatcacttgaacccgggaggcggaggttacagtgagccgagattacaccactgcactccagcctggcgacacagtgagactccgtttcaaaaaaaaaacaaaaaaaaccagcaaatatgccatcactgaccaacaataaaaacaggaaaagtgtcactcaacccatttatgccagaggttgcaattttttaaatttttgcatgagtaaaaacatcagaccttggcgatgaccttgagcagtatgatgtaaaaactcccacatgcttagcgttctaataatggaacactaggcataagtgggttactgttgtcctacagcaaagattaaatttgaatttctggtcatgaaattaaaacaggggtaccacttcaaacccatcagattggcaaaaatcaaagtctggtactatctagtgttggtaaatgtgaggaacaggaactctgcacactgctgggcgagtaaattgatgcaaccacactggagaaccctttgccagcatctagcaagatggaagatgaacacacctcatgacccagaaacaaactctcccacatgtgccctgcagaaactcttctaagtatctgggagacacaggatatttattgtagcatgggataatagtgaacacgaaataacataactgtccctcagtagataaacacactgggcacttaacacaaatggactagaactggatgtagcaacagaaataaatctcacaaccgtgagtgaaaaaggatccatgtagtgtaactgaagtcatataaactttaataacattgtttatacactgatgcagagttttaaaagtacaaaaaggcctggaggtgactcatgccttgtaatcccagcatttggaaggcctaagtgggaggaggcaaggggatcacttgaaaccaggagtttcagagcagtcctggcaacagtgagaccctgtctctaca

SEQ ID NO: 261746 - DNA, 778 bp, Homo sapiens
caggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccagtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggcaaca

SEQ ID NO: 261747 - DNA, 372 bp, Homo sapiens
agacaagatcgaaaccttggtatgtgcttccaaagcctgcgtgcttaccactttgcaggtgcctctttgaaattgcttcccctcccactaactggctcaccaggcaaccagggggcaaatcaaataatggctgtcagtttgtgctggacttcaccatgtaatgaggcatttggggaatgcaaattctgttctacgagtggagcacaaatgtgaacattatagcattagactcgaggcttcctcctgagactgggataataccttgcagtgctttctctgctggaattccagaggttaagcctctgaaaaagacatgatcagaaggagtggcaaactcaggagtaagaggttcatacgcccagtcatgggaaa

SEQ ID NO: 261748 - DNA, 387 bp, Homo sapiens
tttaatggaatataaaaattacatttacacagtaagtttaactctaaacactttttcccccagtatgttgatattggtttataaaaaggatgttgaagagaatttcaccagttgtataatgtaacatgatgctacttctgattaagataaattaaggccaggcacggtggctcacacctgtaatctcagcactttgggaggtcgaggcaggtggatcacctgaggtcaggaattcgagaccagcctggccagcatggtgaaaccccatctctaccaaaaatacaaaaaagtaaccgggcgtggtggcaggtgcctgtaatcccagctactcaggaggctggggcagaagactcacttgaacccaggaggcagaggttgcagtgaacc

SEQ ID NO: 261749 - DNA, 503 bp, Homo sapiens
ctgttttctttgtcttaatgttaaccagcaccaagaatcagaaagggcaagatagctacctgcagactaaactattgtcaacaagtgatgttttgctgttttcctgggaagaagcatggaagttctgtctatgaaaatccgtatcatctgtgctggctgtaattccatgcagttacggccaaaggcgtgcaacctgcactcaccccatgagcctgccagagagccgaggctgtaactcccccaccccatgagtcatcacggcacggcttcattgcattttctgattacagttagtttaatgtgcatctgacctgtgaaatcattgacagcagtggaggaccgccattattcacaatttgtccatcgtcattttgttcccaagaactgtcatcagccgtatctacatgaaggtgtgctggtgttgtcatagaggacattattcccaaactcagtctgctttcagaagcagtaatttcctgccattttggcccattacttgtaaa

SEQ ID NO: 261750 - DNA, 648 bp, Homo sapiens
gacgagcattttggcttggtgaccagaaggggtttgcttcctggggggactgaaagaagcccagcatggctggagtttggaggtgagcaaagcagtgagcagctctgatgaggatagacaagccaggcctgatcacatggggccttgtaggccatgttaaagaatttgagtgtctccacatgtactgtttgcaaactcatggcctcccctttgatgctctgttctaggtgatcgctgcaatcattatctgtcaaacacacctgtgcctatgcataatgttagcttggtgctttagtgcacgctcatattccttctggctggaatggaaatagtattaacttgaattggaatgtgtgctcagagacctgcaagcaatatagtcctgggcaagtttggagccctactgggcctcatatcttgtgaaattatgaagagatgaaacaggatatttccctgacctttttgcaggcaggaacgggagtgcatggatgccagcaggggtgaattccatgaattccacccctcatgggaggagaagtgcaggtgaaaaggtgcaggagctggggcaagcacctttgggcaccatcaagagcaaactccatactggctgttacagtgccctattagcttttctgtctgtggatggct

SEQ ID NO: 261751 - DNA, 406 bp, Homo sapiens
tcagctaaaaactgaaggctgcactgttggcttccctacttttgaggttttgggactcggactggcttccttgctcctcatcttgcagatggcctattgtgggacttcaccttatgatcgtgtgagtcaatactccttaataaactccccttcatatatatatctatcctattagttctgcccctctagggaaccctgactaatacactactctttgctaaacggttcctcctccttaggtgctgttctggtctgagcctcttcccctgactgtcctttaggatgttatccttgaccctctttttcacacttacgtcagagcttccaaactgctggactgaatgtggctcagagacatactttgttagacctgtgtagtgatttaaaataaaaaaaaaaagatgtg

SEQ ID NO: 261752 - DNA, 410 bp, Homo sapiens
aaaggacgttaaattataaaacccagctctgaattttaaatgccacagacgtgagggtataacaccttattaggttgccagatttagcaaataaaattacagtatgcccagttaaatctgaatttgagataaacaacaaataattttttttagtataagtatgcctcatgccatatctagcaaccttaaccttagaaaaccatgcttgattatgtaatattccagctgactggttaatttttaggaggcaggtttgctttttattccctgggttttcatcttttcccattcctgcatgtctcctcagcatatgagatttttttgaatgaatggaaagatcttctgtgaagaagaccattcagttcataaatgaattattttaaagccctgaacccctctgcaaaaaaaaa

SEQ ID NO: 261753 - DNA, 520 bp, Homo sapiens
ctcaaagtaaaagtgctatgttgtgcgtagctctagccattttgttgtaagaattctatattactgatacctaaaaaaggcattttggtcttagagaaaattgtgttgtatgctgactttggagatggtagaattgcaagtgtgtgttcatgccttccagatagaaatttagtggtgaacaatcaagggggtttcacactgtgtaccagctagttatttaaacatcaaattctccttaacttctaattttagtaccagtgtcttcctagaggagaatattttacccaaacagaaacaatagttcagttagacttaaattttatattgtatattatatatacaatactgtaattatactgactaaagacaatactattaattgtatcttataattagtagttgtattttcattattaaatatcttttttttttttttttgaagtcagggtcttgccttatctagtcaggctggagtgcatgcagcgcagtcacggcatactgcagcctcagagacctcctg

SEQ ID NO: 261754 - DNA, 468 bp, Homo sapiens
atagaattctgttctcttttttaggaattaacatttgtatcctttccatggaatactcgttaagaatacatcaaacgcatgcggtacaaatgaatacttcgaggacagcctgatgattacatgacacctggagatttccatggggacctgtgtggcttgccgttccagttctgtcctctccggggcttgggaaggttccacccagctggaccccgcccacgggcccacctggtgccatgcatggagaggtgaacacggctcccaaggccaagcatgacagaactgggcagaaagagactcggaccatttttcaggagcgatgaccatctgcggacaaggccaaccagccttcctgtcctaagagtcccatttgtccaataaaactacttaaataaaagcaccacccctctccatggccccccgccagaaactacaggaagggatggttcccttaccaaaaaatttcca

SEQ ID NO: 261755 - DNA, 258 bp, Homo sapiens
tcattggtgcttttagcaaggttataaatacctaacgtttgtgccttatgtgataaatagaataaagacattttaaaaatagaattttatggccttgagattatttaatatgtaattcaaatattttaattgaatatttgaatatttctgtaggtattcctttctttcacttactagtcaaagacagcatttccatcacctagcagaaaggaaatggatcttccaacctgggtaacatggcgaaaccccatctctaca

SEQ ID NO: 261756 - DNA, 285 bp, Homo sapiens
gcccccttaaataaagtaattagtttaggcagttgtaatcaatggataaaactcttagatggaaattgatgatgaactttattatggaatcatcagacaatctcaacctggacctgtaaataatcttagccccactaaaagtgggataaacagacatgtgtgagttgatgtaccttaccatttatgaactactgttttaaaaaatgtgaagttaatcaagcttctagaagaaatttttgttccaagggacaactcacacggtgtctgcaataagtcaaagacatg

SEQ ID NO: 261757 - DNA, 429 bp, Homo sapiens
tccattttgcagaagagaaaacagattctcagagagctaaatgccaggcttgaatccaaattagtctggcaccaagatcggagcatttaaccactatactgcctcccagtcccgttcaatggggaacaaacacttctacagtctcaatatcttcacaaaattctcctaccactccagtcttaagtgaggataggccgtccccctgcagcgccagatctgcacactgacctttactgcactctttctactctcttgtctcccactcccactgggagcccagacactggcttcagaagctctcctcctcctcctctattgaccatcctcttcatcctctcactctctactggctgcttcctacccacgaattgtgggaaatatgctaaaatatctccaatttttaaagtacaacaaaattccccctgaaaa

SEQ ID NO: 261758 - DNA, 343 bp, Homo sapiens
attataaacatgtaaactattttaaacaagcatctcacctttaataatacatccttttaataagagaattcaagattatgtactctttaaggaaaagtgttttattcatctttgaaccatcatactgcatagtacatagctgcttaataaaatatctattagaaaaattgatgaatgcatggaactgtttcattcataccccttacatttttgttgagtgcctactgaaatgaaagaagtcagtctaatttggtgactaaaaagttactggtatcttaaagaaaataccttaagtaggttggggcaggaatggactagggaaatccaagaactagttactcat

SEQ ID NO: 261759 - DNA, 1169 bp, Homo sapiens
ctaatttttgtatttttagtaaggatggggtttcactatgttggccaggctggtctcgaactcctgacctcagttgatccacccacctcggcctcccaaagtgtggggattacaggcgtcagccaccgcacccggcccttttctgtaaatctaaaactattttaaaacaaagcatttatttaaaacttttttaaaatggtgcttttccgttttctttagtctggaacctttaccagaaggttcattacagtgtccataacatggtaggtgtggaataacaagtatttgaaagaggaaagaaagaatgagagagggaaggaaggaggactagagaagagaggaaggaaagaaggaagggcaagagggagggagaaagatattaagggacaaaatacgaaagtaaatagaaccagtcaggtgtggtggctcacacctgtaatcccttcactgagaggcctaggcaggtggattgcttgagcccaggaattggagaccagcctaagcaacatgatgcgaccccatctctactaaaaatacaaaaaattagctgggcatggtgtcgtgtgcttgtagtccccactgcttgggaggctgacgtgggaggatcacctgagcccaggaagtagaggccgcagtgagctgtgattggagcactgcactccaaccttggtgacagaatgagaccctgcctcaaaaagaaaaaagtaagtagaaccattcatcaactgataaatggataactgtagtatctctatgcaatggattcaatgggatattgggccataaaaagaaattaagtagtaatacattctataacatggaagagcttggagacattatgctaagttaaagtaagtccaccaaagagaccacatattgcatggttccatttatatgaaatgtccatatgcagatatgaaatgtccaaaggcaaatccatagaatagcaaatagatgagtgattaccatcttatctgttggggactgaggaggagaaacaggagcagctgctcacggtcatagggtttctttttggggcaatgaaaatgtcccagaattagacagaagtgatggttgcacaaccttgtgaatatattaaaagcactgaattgtacactttaaaatggtgaattttatggcatgtaaattacataataaagtttaaaata

SEQ ID NO: 261760 - DNA, 88 bp, Homo sapiens
actccagagacagatgtgactgtgcccctgcacccagcagagggcccagatagagtggggtgcaataaacatttggtgaataaataaa

SEQ ID NO: 261761 - DNA, 394 bp, Homo sapiens
  misc_feature (343)..(343): n is a, c, g, or t
ttttgtatttttttgtagagatggggtctcactatgttacccaggctgatctcgagctcctgggctcaagtgatcctcccacttcagcctctcaaagtgctgggataataggtgtgaccattttttttttatatacgcacatgtagccaataaaggcctacaggaaatgccaccatttttttcagggagtggaggccaccttcccaccagggacacctaggtctgccctgccctgccccgccctgccccgccctgcactgacaagtatgactttttttttttttttttgagatggagtctgtcgccagactggagtgcagaggttgcggtgagccccgagatntgcctttgcactccagcctgggcaacaagagcaaaaagctctgtcacaaga

SEQ ID NO: 261762 - DNA, 232 bp, Homo sapiens
tcaacctagtaacaggcaagcagggaggaaaaataaataaataaataaataaataaataaacaaataaataaaataacaaagttacagaacacaaagaaaggctgactaaatagtccacattatagaagatcttaaagatatgacagcaacatatggtctggaatttttatcttaaaggacattattgaaatagttggtgaaatctcaataaagtctatagattttataata

SEQ ID NO: 261763 - DNA, 492 bp, Homo sapiens
tttttgagaagtttgtctctgtcctgggctccttacccattgaccatttgctgtccacctactgggcggatgttctggcctgagtcaaccctctgtcccactctgtcacccaggttggaatgcaatagtgtgatctcgactcactgcaacctccacttcctaggttcaagcaattctcctgcttcagcctcctgagtagctgggaccacaggcacacgccaccacgcccagctaatttttgtatttttaatagagacggggtttcatcatgttgtttaggctggtcttgaactcctgacctcaggtgatccacccgcctccaactcccaaagtgctgggattataggtgtgagccaccacgcccagctgacctcagtcttataaccacaaggaattgaatttggcaaagcccagcactgctatcaccctgattttggccttctgaaaccataggcagtgaactgaggtgagccatgccagacttctgaccta

SEQ ID NO: 261764 - DNA, 323 bp, Homo sapiens
ccttgcttctatgagatcagtttctggagtgtgcccagaaccagggtgacatcaagctctgtgagggtttcaatgaggtgctgaaacagtgccgacttgcaaacggattggcctaatcaagaagttcaacctggagagatggaaaatcagctctcataactaagttaatttagtataaaaatagaattgatagtgagggtataaagtgtaaccatgagttaaacctctcctgtcattcctagcttccttgcttcagaattgaaatggaaggggggtgtcctactctgtagaatctgtgacagggcaaatgtttgtgtggcctc

SEQ ID NO: 261765 - DNA, 387 bp, Homo sapiens
gaggtcctcagagggaaccaaccccccggcaccttgatcctggcctttatgcctccagaactctgagaaaatacattctgttttttaagccacccagtgtgtggtaccttgtatggcagtcctagcaaacgaatacagcccttacgcaaaacgtacagctaatatcacacttaacagtgagaccaaagactttcctccctaagatcaaaacaaggcaaggatgtcttttgtcaccggtcccactaaacattgtactattgaatgcgcaatttgtgcaataagttaagaaaaagacattaaaggcatccacactgaaaagaaagaagtaaaactatcttcatttgcagatgacataattctactgtagaaaatccgaaggaatgtgta

SEQ ID NO: 261766 - DNA, 410 bp, Homo sapiens
tccttactgttggtgccatggggagctcagcattggtgtctgcttataacagaatatattgtggggcattctacgttgaattcctcagtgaggggaattgtcactgatgaggagaattctatgtcgttaacctcttccataaccaaaattcctaccaccatgctatgttccacttcagtccattgatctcctgttaagtggatattatgtgactggtaaaaaagtagtcatgtataaaccgcctgattttggaaaacctcctctgcagtgaatattctctggtgaatatttacatgagaaataaatatattcacaagctaagcccattttgagagatctgcctacatggccctactttagtcttgctagtcttaatgttccaaacatatttttctctgactaaatgaaaa

SEQ ID NO: 261767 - DNA, 639 bp, Homo sapiens
gagtcggagtcttgcactgttgcccaggctggagtgaagtggcaaggtctctgctcactgcaagctctgcctcccgggttcacaccattctcctgcctcagcctccagagtaactgggactacaggcgcccaccaccatgcctggctaatgtttttgtatttttagtagagacggggtttcacagtgttagccaggatggtctcgatttcctgacctcgtgatctgcctcggcctcggcctcccaaagtgctgggattacaggcgtgagcccctgcacctggcctaaaagtactcattttttattcatcaataattagtaatctgactcgtttcaaaaatttgtttattattgacaacctctttgaagatccatttcacaaactcaacagagtgccacgattaagagctagggatcccccaaactacctcaagcatctaaaaaattgccattttttaaaggcttaaattgtagtagtaaagggggaaaaaacccataaatcatctaaaaaattgccatttttaaaggcttaaattgtgtgtgtgtacacacacacacacacacacacacacacacacacacatcattgacctttcttaagacttcagagggtggaacttccggatgtgaccacagagag

SEQ ID NO: 261768 - DNA, 298 bp, Homo sapiens
ggtctgagcggaaatgatctgtaataaacaccatgtagagtggctctgatggccccagacggcaccaggagggcagtgcagggctggatgcgaagcccgtgcaccccccccccatgattaatattggtgagcctggagtgaaggacagaggcaaagaacggacttccagttgaatcggtattatgttaaattcaggatgttcaactcatgatgtgagctccaaggcatttgctcccaacactagacgacgcttaactagatgggctcattggggtgggcgtgggagagcagcagacat

SEQ ID NO: 261769 - DNA, 218 bp, Homo sapiens
caccattgcactctagcctgcgtaacgagcaaaactctgtcacacacacacacaaaataataacaataataataataaaacattgccgggcacagtggctcatgcctgtaatcccagcactttgggaggctgaggctggtggatcgcgaggtcaggagttcaagaccagcctggccaaggtggtgaaaccccatctctactaaaaatacaaaaattag

SEQ ID NO: 261770 - DNA, 477 bp, Homo sapiens
  misc_feature (416)..(416): n is a, c, g, or t
  misc_feature (426)..(426): n is a, c, g, or t
gatggaatatctagaagccttggcttaaatatagaacaaatgatattgagctacttaatcttactatcactgtaccaggttccataaagatgatgccttggtcagctcaggctgctgtaacaaacaaaggcacgtttcttataaacaatagaaacttgtttttcacagtctggaagctgaaactctgggatccaggtggcagctagttggttgttagtgaggctctcttctgggtttgcagatggctaacttctcaccatagcctcacatggttgaggatggctggagaactctctagggtctctctctctcttgctctctgtctctctttttttaaaagcagcatctcgctttgtcacccaggctagaatgcaatggtatgatctcagctcactgcaacctgggaggcggaggtngcagtgagcngagtacttaccactgcactccagcctgggtgacatgagggagacttggtct

SEQ ID NO: 261771 - DNA, 496 bp, Homo sapiens
tcccagggatctagagacccacatatacaacagctttaggtgtacagcagatttattggctaacattaccacttctgctttgaaaattactcaacagggaaataaagcacaaaggttttgaagaagttttattaatttctaggaataacattaaggtttcagttttcaaacatttttgcaacctatgctaccatgtattttggttataatatatgttattttgagagtagttgtacaccgggtgcagtggcttacgcctgtaatcccagcgctttgggaggccaaggcaggcggatcacctgaggtcaggagttcgagaccagcctggtcaacatggtgaaaccctgtctctactataaatacaaaaattagccaggcgtgttggcacatgcctgtagtcccagctacttgggaggctgaggcaggagaatcacttgaacccaggaggcagaggttgcagtgagctgagatcgcaccattgcactccagcctgggc

SEQ ID NO: 261772 - DNA, 286 bp, Homo sapiens
ggaatgagtgtgggttatggtgttagctccatgtgagcttccatctctgttacttgttaactggatatccttgggaaaatttcttactccctggaactttagcatattcttttaagaatgttgaggggatgtatgagatagtacacgcaaagcgtgtttgacacattagtttctaggtcaaaggtcagcaaactatgacccgtgggtcaaatatggtccgtcactggtttctttatgaccagtgagctaagaatggtttttatctttttaaatgattgaaaaaaat

SEQ ID NO: 261773 - DNA, 416 bp, Homo sapiens
ccaagcagtgacttgattcatgaacactcactggatgctgactctgtttctcttctgagtgctggggtagaggagaggagaggtggagcacagttcttgcttttatgagcttatgttctaggaagttcaagtatttttttcaggtagtatgaaatagcaggaagaggaagcaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctt

SEQ ID NO: 261774 - DNA, 400 bp, Homo sapiens
gattatagtgctgctatgagcattcttacatatgtcttttgatgaacttaaggccacctttggtatatacttaagagtggaattgatggatcataagttcagctttagtaggtactgccaaatagttttccaaagtgtttcactcttaccagcagtgaaggagagttccagatgttcaacatccttgccagcactagacacagtcttttcatttcagctctgtggtaggtgtgtagcgggtgacatctgtggtttgatccttagtctttttctgtaaaataatttgggtcccttctagttttgacagtcattgtttataaaattataaaactcctcatggtatagtacatagtagaagcaggaaaataccaattgcccattagttatctgataacagaag

SEQ ID NO: 261775 - DNA, 618 bp, Homo sapiens
caccattttacagttccaccaacagcacacgagggtttaacttcttcacatccccaccagcacttgttatattctgaattgtgttgttgttttatagtagccgtccaaatgggtgtaaggtgatagacagctcattgtggttttaatttgcatttctctggcgtgagccaccatgcctggccttacacagtgtatcttaaggtgtggagacctaggattaatttctcatacttgtcttaggacagcagcattgaaatgaaattcaaaatgttacaattagaaaaatataattctcaaacctgtgtatcttagagtattttcaatggaaattgaaacccgtttttcactatcatttgtgttgtggctctttatggtctctaggaagaaccactattcctcaaaccttctattttttagattacttcttcaactttctatgtcagattaaaaattaagaaagcgtttactgaaagattgagcccttcatttttgcaaaacctctgccaatgtggtgataactgtcaataaactgcttattccagaagcagatctaagaagcgaggtacaagccacaatttactgccccgtttagcccaataaacagagaaccttgtcttc

SEQ ID NO: 261776 - DNA, 497 bp, Homo sapiens
gtttatctactacattaatgtagctgcagctacattaatcagaatgaataaacggaatttaaagttgagttccaaaagcaaattgcaaaagagtgcatatggaaggatttcatcatatgaagtttacaaacagtattttactacaatattaaatagcattttatttacagaaacatacatatatggtaaactataaagaaaatggtgatacaaaatgcaggatagtgtttacttggggagtggccaaaggtacaatgagagagataggaccaaggaggacagacagaggcctttgaggctagtgggtcttggtcccgttcttaaactataggaattcattttaatgttacattttgtgtttatattttgtcataaattttttgtgcatattcaatatgtaaccacaaaatacaaaaaaactctctaaacagttgacaagggagtttattaagcaaatagaggtaccaattacaaaccatcagggttagaaaaaaaat

SEQ ID NO: 261777 - DNA, 326 bp, Homo sapiens
gcctttgccaactaaagctcaggagtaaagtggccatcactgaggccattctatgtatgtatgtatgtatgtatttagagatggagtcttgctctgtcacccgggctgaagcacaatggtgcagtcttggcttactgcaacctctgcctcccaggttcaagcaattctcctgcctcagcctcccaagtagctggatgtggtggtgggcgcctgtaatcccagctactgtcaaggctgaggcaggagaattgcctgaacccaggaagtggaggttgcagtgagccgaaatcgcaccattgcactccagcctgggtgtcaagagcaag

SEQ ID NO: 261778 - DNA, 183 bp, Homo sapiens
atctccacatgttcatctttagtctacagaatgatgattgacttttttctgtttatttaatatcctctgatcatgcagaactcattcattagttcaaaaaagatttttgtaaattgttttacattttccatgtgtacagtctgcaagaaagaagtgttatttcctccctttctatatgttgtt

SEQ ID NO: 261779 - DNA, 516 bp, Homo sapiens
cattggtggacacctaactgaattgcaagctacttataaacttacaggaaaatatggagttagctctgagcacatagcaggaggaaagtggccttcataagtatccctcataaggaatctccctaaatagaaattaaacataaaggagagagaaaacttactttcttgactcaaagtcagctgtcaatgactaggctgccaaaggaagtcattgcattatgaggacacctagctgtgaagcttagtattgcatgcctgctctattagcgcagccaaatagggaagaggaaaggagttaatttctaagttctcaggagagtttaggagatctggatggttgggttaacagtggaaagatctaggaaagtgtcctaaagaaagaaaagaaaattattgactccagttcccatcatgagggtatgtataatacatgcatacacaagtgcacatcaacgtagaagcatctcactgatgatatgccatcatcctgacaattttaagtccctttgtaaaaaa

SEQ ID NO: 261780 - DNA, 332 bp, Homo sapiens
cggtcctgtccttgggggcccagcataggtcagtgtcagatgggaccagcttagtccttcaactggatgcccggcctgggccagtcgctttcctccctaagccttggtttccccgtcaataaaggggaggatggcactctctcaggcaggctaggacagggagtgaggcccagagggggtaggcaaagtcccaactgcatggcctctgtgggatgggcagggcccctctgtgctgtgttgacattttcagtggcataagttttccctttggaggttatgcgtctttgtgacttactagaaacgataaacaaataaaacccttctagccaaaa

SEQ ID NO: 261781 - DNA, 817 bp, Homo sapiens
  misc_feature (34)..(34): n is a, c, g, or t
tgatatatatcgctcattatgggaattgcccttnagcccaggatcggcacgaggacagacttcctcccccgtgcttgccttcagagggctcacaatctagtgagcttgatttctgtgagtgcagagcagaagctgaggtggaaacagagaagtaaaaaatggacacaccagaggcagaagagtgacagcctcccagctgtttggggcagttgagtatggtggggaaatagctcaagctgtctttgcagcccctgaagacatcactgtaccctattgaaccatctcagggtgatgctattgttacgctgatccctgcaacgcttgcctgtgccccagcccaggatcctggcagctgcagagaaaatggcagtaacactacctcaaaccaggaccacgccctcagagcctgcaccctgggccacctgggagtcagagaccttcacctgggctatggggttctgggttgaggctggggttcccggcctagggaagggcttccgggttgaggccgggggtcctggcctagggaaggagatgcccctgtgtgctgggttacaaggtcatggccctgggaacacacttccttttctttctgggtcatttctgcctctgcagtgaaggatgccacagggtacaccctctctgctgtcatgactcaggacaggagttcctggtcacagctgagtcttcggatgaggtgaggggtagcatgctcctgtgctctgttgcctaaggcagggcagcctacaacccacgttagaaacagcgtcagcactaagggctaaaataaaactactttcaacatttaaaggggtca

SEQ ID NO: 261782 - DNA, 471 bp, Homo sapiens
tatttttatgtagttggtccatctgaaatgtaacaaatgcatcaagataagagtatatttatttgctagcagtgaagtgtttttaagtaaacggttggggagagttatgtaactgacactgttggcaaatgtaaggattgaaaacctttggtaataaaggttcatgtgggctgaatacagtggctcaggcctgtaatccaagcactttaggaggctgaggtgggaggatcacctgagcccaggagtttgagaccaacctgggcaacacagtgagacctcatctctacagataataaaaaaaaaaattggttggctgtggtggtgtgtgcctgtgattccaggtactcaagaggctgcagtgggaggatcgctcgagcccaggaaatcaagtctgcagtgagctgggatcacactactgtactccaaccttccagcctaggcaagagagtgagaccctgtctaaaaaaaaaa

SEQ ID NO: 261783 - DNA, 416 bp, Homo sapiens
gggagtccaggttcttggcatcttgaacaaagaattggacagaacgcacaaagcaaggaaagaatgaagcaacaaaaacagagatttatttaaaatgaaagtatgcttcacaggtgggagtgggttgagcataggggctcaagagccctgttacaggattttctggggtttaaataccctctagaggtttccattggttacttggtgtatcccctatgtaaatgaagaggatgaagtaaagttacagtcatttaaatggagaggatatttcctgtcatagctaaagtgtttccatttaatttagttctaggaagtcagcatgaattggccttatgttccctgcctccacactctattctcctgcctccgtctcacactctagtttgagggaaattacgataaagttactccctgtg

SEQ ID NO: 261784 - DNA, 378 bp, Homo sapiens
aactgcctaaattctagagtttggggcaggaatgtatacataagtctggaacatcttgccacaccagacacaaggatcatctgttagcgatgacaacagaaggatcatctcagaaggactcaggagccaaactaaatacactctccctgccaaaggaaatacattacagcccagtgcttcctacaggaactgaaaaaccagatggcctggatttgaattccagcttccacctcctacaggctctgtgagcttggcaagctccttaacctccctgtgcctcagtttcctcggctgtaagatggggacaatggtacctacctcacacaaatttttgagaattgatttggtgtaaataaagtacttataacaataaaaaaa

SEQ ID NO: 261785 - DNA, 407 bp, Homo sapiens
ccacctctgaaaaattattttacagcagcagttctccaagtgaggtccctggaccagcaacaatcagcattatccagaaaatgtgaattctcaggccctacccagatctgtggaagcagaaactcttggggtagagcttaacaatctgtgggttaagaagtcctctgggtaattcaaatgcatggaaatacattacagcccagtgcttcctacaggaactgaaaaaccagatggcctggatttgaattccagcttccacctcctacaggctctgtgagcttggcaagctccttaacctccctgtgcctcagtttcctcggctgtaagatggggacaatggtacctacctcacacaaatttttgagaattgatttggtgtaaataaagtacttataacaataaaaaaa

SEQ ID NO: 261786 - DNA, 446 bp, Homo sapiens
ctgcttaaattgttgaaaagctgggaaaaacctaaatgtacaacagtgggggattactgaactaattaaattatgtgcataaaattgcaaacattcttatatatttactgtatacataatgtttaaaatatggaaaaacaaggagtgttctatgtgcccagcaacagagagttcattgaaaaaaaaaaatccaaaatgtgtgtagtacattcatataatgcagcataccagcatggcacatgtatacatatgtaacaaacctgcacattgtgcacatgtaccctagaacttaaagtatgattaaaaaaaaaaaaaaagaaaaccacgaggccactaaattgcccctggcctgttatatgtgatgttgtcaacttgtctttgttgatatgaagctctgttcataatatactaaatgaaattaacaaattaaaaattagtatacacac

SEQ ID NO: 261787 - DNA, 317 bp, Homo sapiens
gagttgaaaatgatagatttcatagcattgtttttattgaagatgagtattagattatgtgggtaaggtgttgctttccaacctcatggtataattaaaccaatctcctttccagctcccctctactttgggggttctataatctttcttttgagatttgttgagattgatcttggaagatggaagagaactattctatctgggccaagaagatgactttataatgactgtattatatttacacaactttctttagtgttaacaaggacattgactacttggccaacattcaattaaaagatgtttaaaagcaagcc

SEQ ID NO: 261788 - DNA, 463 bp, Homo sapiens
agttgagctctagtgggatgggtggtgctgactggggcagggtatgagataactttctgtgatgctggtcatgttatatatcttgatctggatggtggttccaatgtgtaggcaaaagcaaaaattcattgagctgtacacttaagatttgtatgctctattatatgctatacctcaataaagtgaagtatagcaatacctccatagaaaatattttttaaaaagaggaaaaagaaaatgttcaattgacccaaaatatcgaaacatgggctttagaaatctagatttgaatctgattctaccattcactgactgtatcaacttgagaaagttacccaacctctctgagcctcattcctctcatccgaatatggagataataatatctacctaataggtttactctgaggagtaaattaaataagcacgtagctcaatgtttgtcacattgttgttaaacaaa

SEQ ID NO: 261789 - DNA, 255 bp, Homo sapiens
tcacctctcccccttctgcaccaaatcatgcccacctcccttctgaactgctggaaaccaaaatcttcctgaaagcaccccaagctaacttatggggttaggatcaccacacccaggattccctcagtcctcctatctttagacttcttttctttttgaggacacgattctccaaagttaacttctataaagcaaatcctatttctcactgacccatattttaccaaacagctggcactgcttttttcacagctg

SEQ ID NO: 261790 - DNA, 425 bp, Homo sapiens
tatattctaccaggtagcgaatgtatgagcatgttagagaagtaaaaaatttaaaaaacaaaattaaacatctagaataaaaagaaaaaatatctgatatgaaaaataccccatatggaattaacaacagtatacacattgcagaagtgtgcttgtagtgacagcaatagaaatgacccaaaataaagcatacaaagaggagaaaaataaaaatagataacactgtagtaaattaacagtgcatcagtgaactatgagacaactttcaatggcttaatgtatgtttacagtaattggagaccccaaaggacagaaatgatgaggtggcctagtctttgagaaataatggccaaaattgttctaatttgctgaaatatataaacgtacggacccaaggagcttaacaatccaaatctcaataacaa

SEQ ID NO: 261791 - DNA, 310 bp, Homo sapiens
ctgccaagaattccgtgtgacgatggctctcagtggacattctccattgtggatggcttcagtagtaaatccaggtggctgcctgtggatatctcatctcatgctgtgactccagccatgccttgcccctcaccagctctgacaccagcagaaggaggagatatggcataagcctggacaacagatgcttctctaagatgtggactcttgaatgagaaacacaaggatagaaggaatggttgaaacatactttaaatggatgagtggtatgctcttgaattatatctcaataaagctgttttttttaaaa

SEQ ID NO: 261792 - DNA, 404 bp, Homo sapiens
ctggctctcctagcgcctttcctggaggctgctctcaggtccttcccacatgcaatgcatgcctcttttgcactgagtctttctaatgcttcgagtctctctgatttcctcctctactagtcagagaaaattctctgcttttaaaagacccatatgtagtaaatccaggtggctgcctgtggatatctcatctcatgctgtgactccagccatgccttgcccctcaccagctctgacaccagcagaaggaggagatatggcataagcctggacaacagatgcttctctaagatgtggactcttgaatgagaaacacaaggatagaaggaatggttgaaacatactttaaatggatgagtggtatgctcttgaattatatctcaataaagctgttttttttaaaa

SEQ ID NO: 261793 - DNA, 678 bp, Homo sapiens
gttggctgggtgtggtggctcacacctgtaatcccagtactttgggaggccgaggcgggtggatcaccaaggtcaggagttgaagaccagtctggccaacatggtgaaaccctgtctctactaaaaatacaaaaattagccgggtgttgtggtgcacacctgtggtcccagctactcaggaggcggaggcaggacactcgcttgaactcaggagatggaggtgcagtgagccaagatcgcgcaactgcactctggtctggatgacagagcaagactccatctaaaaaaaaaaaaaaaaaaaaaaagaattttgtctttcacactggctggcagcactgatccctgacgtcctgcacatctgacaaaaatgattgtctcgcgtgctgatctgagtcctatctggtgctcacctaccctctggtcatctgttagccactcatctccttgtttgttggttggttttcagagcagactaagatactaaattcaggacactgttgttagaccacattaaaaatgcaggcggcagtgcagaacatggctggctcatgtcaggccgacttctcagtgtaaccagagaaggaaaacatggacagggcccgtgttaatggaagcagacgccagattgcatggcaggctctggctcctgtttctcctgttccctgccgccctccagcc

SEQ ID NO: 261794 - DNA, 602 bp, Homo sapiens
gacacagaaaggtctgtggccagctccctgaaggcagcagagtcctgaatccagatgcaattctaactcacaggagtcatggtaacaagaacaagaactcttatgaaaactcttcatggccaaagacttgtcacgcgtttcctcatcttatcatcccaagaagcctggaattctcccattttacaggtgaggagagggtattcagaatggctaagggactcaccccccttaaggaggagcatgcactctcatcaaagaatgtcccaaagttgaacagaaggtcagagtcaaaagcttgtgctcctcctactgcagcctgtggaggtctttttccctagtcaagacatcggaatgtggggtacaagggagaggaaatggacttggcatgctctctgtctattccttgagaaaggttatacacacatatgcacgtgcacacacatgcacacacacacattcacatgctcgctcgctctcttttcttatatcaaactttgcaggcttcaaaatcattcccaaatctttctgattttttttaaatttttaaatttttttgagacagggtctccctctgttgcccaggcttgagtgaagtggtgtga

SEQ ID NO: 261795 - DNA, 814 bp, Homo sapiens
aagagcagctgtctgcacagtgggaggtaactggacggtcagctagggctaggcacaggcctcatttatcagtgtgaggggtcagacttgaccctgtggtcaggagagtgccatcatagatttatagatacggcttgtgctgtcatctctgggacccccaaagtgaggacccagtgagttggagctgagtgtctgttaggtatagaggtaagatactacacaaaggaaactcagttttgtgaaaaacgtgtaaatatgtttttcaaacatgttcttaagactttttaatctttctatgttcttgttgtctggttatttcccatgaatgttagggatcagatcactgctgtgtaaataatagtccacccaaggtattcatatgcatttcttgacatggcctaaggcaagagtcctgccttccattgtcccctaatttatatttgcttctttctggagagttttaaatgaatttcaagggcttgatgcctttaaaatcagtggatcaggccctgtgttgcgagatttcttaatgggccacagttgtctctgtgattctcatttccagtttatagcactactgtccacctaaacatacactaaccatgtggatcttaatgatgttttaagaaaaaaggttttgacatacatgccagacttccacttaagatgaaactgggcaactaggaaatggtatgccgtacatatgaagcactgtttattgaatattggtggcaaattttgttttgttgctaggaccagattcttggagtgtgtagtaggaataaataagaccaaacacaatcttgcttcactg

SEQ ID NO: 261796 - DNA, 469 bp, Homo sapiens
tcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcaggggcatgtcagatgcacctctgtagctgcgtgtccagatgccatggagtgagatgcctggttttgctcatagagttagaacattatcagaaaatacatgtatttgagttaaattttagagagtgagtagaaattcatcgggtctacaaggaggcaaagagctttcctggatgaaattcctccttggcgttcacctaaaacttactaatttcttacagaacatggatacctatgtaacctgcatgttctgcacatgtaccccaggacttaaagtattaaaca

SEQ ID NO: 261797 - DNA, 462 bp, Homo sapiens
gttgcagtgagccgaaatcgcgccactggactctagcctgggtgacagagcgagaccctgtctcaaaagaaaaataaataaaaataaagtatatggaggatgtgtgtgagttatatgcaaataccatagcattgtatataagggacttgtgcattgtggattttgatattcaaggaggggtcctggaaccagtcccccacagatattgagggatgactatactctgaaccaataccttttgtttttctgaggtcttaataagatgtttcacagtcatatgtttgccttcatctttagaccacattttcttggcagtgctctggagcttatccttgctcaaaagcctttttttttttttttttggtagagatgtctcattgtgttaaccaggctgaggtgggaggattgcttgaggcagtttgagaccagcctggtcaatataacgagaccccatccctttga

SEQ ID NO: 261798 - DNA, 409 bp, Homo sapiens
gaaggaatagtctttatatgggcattcagctgtgaaagggcccggtgtgtacagaacagtaagaaattgaacggttggggtataggggtgaatggtggagagaagaaaacagtgagactggagatttagaaagtccactatttaggccgggcgcggtggctcacgcctgtaatcccagcactttgggaggccaaggcaggcggataacgaggtcaggaaatcgagaccatcctggctaacacggtgaaaccccgtctctactaaaaatacaaaaaatgagccgggcgtggtggcgggcacctgtagtcccagctactcgggaggctgaggcaggagaatggcatgaaccgagatcacaccactgcactccagcctgggcgacagtgcgagactccgtcttaaaaaaaaa

SEQ ID NO: 261799 - DNA, 521 bp, Homo sapiens
attcataaaagaaaatattaataaattggacttcattaaaatataaaattttgtttcaaaaaactattaagaaaattaattggcccggggaggtggttcacatctgaaatccctgcactttcggaagctgaggtgggaggatctcttgaccctgggaggcagaggttgcagtgagccaagatcacaccaccgcactagagcctgggtgacagagtgagaccctgtctcaaaaaaaaaaaaaaaaaaaattaattgaaaaatcacagactgggagaaaatattttcaaaccataataagtatctgatagaggacttgtatctagactatgtaaagaattcttaaaactcaaaaataaggcagacaacttaaaaatggacaaaatgtttgaatagatatttcagcaaagatatacaaattgcttagcatatgaagagatgtgtactatcactagtcattaggaaaatacaagttaaaagcaaaattagataccattttggacccactaaaatgactataataa

SEQ ID NO: 261800 - DNA, 557 bp, Homo sapiens
caggttttaattgaacatctgcatatatttttctctgattaaatttgagtttgatttgccacaacaggcagacatggatccactcgggatctgcttgaaagaaccaatattgtaatgttgactcccaggctgcacaaacgcagaggccccattgaaacaaacttctggccattcgaatatgtcctagactgctctcaactggagacttattttagtcttaagtggaatttcttttttgatctaattcctggtgttcagaaaatcattacttgtccaacctactaccgtacatcactgataaatccgcaatttctggagcgcttttcagcacgatgccttcatttctgctgcctaagaatttcagaagagcaaagagttgagccctggctggctcacatgtagagacattcacagatagggttggctgagggtggaaattggacccagcaccttctggtttcatgtgctcaatgttcctgttaagaagttgggtccacccgtggccctcagtgggatgtgtatgttatgtttattaagagaggtcgcacgttcccact

SEQ ID NO: 261801 - DNA, 794 bp, Homo sapiens
agcggagttgaaggatttgagacaggatcactaatagtttttgtgaagcactggcatagttgagcaagtcagcttttagtgaaatgtgaaaatttaagcaaaccccagctaccaaaactgaactgtgaagggaaagctaaaggagagatagacgcgaaagtgtgctgctatgagatggccacttctatggttccacagttgtggtttcatccggttgagggcttatggctgctcagtctgcagtgtggaaaatgaaccagatgcaaatctgagtacaataaaggtaaactggatgtatttaactgttttgtatctatacatgaatgtatctgcccacatccaccttctgatattaatgcagctgttgcattttcgttttccaaatctcatgccaatttctcttgttgttaatcctaatctgggaccatacaagactcgggattctaggatacatagtttcattttagctcagtttccacctaaccaaattgacctggaaacatccagcacatatataagaatgcttcattaaataagtagtcactgtttaccttggtatgatattgcaggtacttctcagtgcaaatcagagctttctatgagctatacctgacctttcatatgccaatcaatatttctctttccaaattctaaacggtatctcagaatctattgattgcgtttttatttttctggagagctccagtttgtagaattctagtctcctactacaaagtaggttgcattctttatgcactgtgtctgctgagtgtatcttttgtttcttaaattct

SEQ ID NO: 261802 - DNA, 412 bp, Homo sapiens
ggcatagtttatggtggacatttcatattgaaaataaggagattaagtaaatttgtatttacttctgctcccagaatgctggcaactgggattaggacaggagattagaagattagaagagtcttgtctggagaatctgactctccccaagaagaaagaacttagagatgcagatatcagaggcttctcagtaaagggctcaggcagtcacactacagtgagatttgttatcagggggtttcacccaaggatttggagcttcacatcatgttttagttctcgtaattaaatatgaatggaaaatagaattgccagacatctgaggatcctcaaagcctctatagggtacagtcccaaacaaagaaagcaacccacatgaaacatacttttcagggaaagcataacttcgaaa

SEQ ID NO: 261803 - DNA, 250 bp, Homo sapiens
aattccctaggtccatgtcaatgttgtaatacagcctattttgcagtccacagaaatgatagcgctgccttgagaggcatatggccaaggggtcacagtgcagagccccagctctatggcaggagagcctcacccacctccctgcctccacatcctcaccatggaaataggagcactgttggtacctacctcgtgagggcggttctggaattactcaaacacatcatctaagatgctttgtacagggcct

SEQ ID NO: 261804 - DNA, 613 bp, Homo sapiens
gtgcatatgcgcgcatgcagtgcagggtctgcatacctaaagcagatgaaattctgcagaatggctgcctcactagacaaagtcaagaagacagaccgaggagagagaggttgatgtgtctccactaccaagagataggcttctctaagccagcgagacatcccatccaacaatatgaaactggccacatttccttgagatgtcaacgttgaaagtgtagctgcatctttattcttcactgttatgaagttgggtgcaacacagcttgagtggaatacaaaaacaccgcttggaaacacatgatctggatttgaatcgcagctgtatcattcacctgctatagactttgagcaagacctctctgaggttatttcttcacagtaggtagagacaagacttacttcaaaggttcttaaagttgaacctgagtcaatgaatgcaaaagtgttcacatttaaactgtaattttaaagcacaatacaagtaaatagcattaatatcattagagagattaacttagcactgtgcgtcacatgattcatcacgggccatctgtgagatatcaaatagagaggtgaagcctgcagtaataaaaaatactgccatagctata

SEQ ID NO: 261805 - DNA, 326 bp, Homo sapiens
tcaggggaagaaggcgtcctgttctcgcctctacggacatcagagcttgctgcgctgacctccagtgagacccatgtccttagccatggtcacaggtttagtccagcagtctggccctagctcctgcctaccactcccaccctaggaggccagtgttaggcggggaagccctggtctctgacctctccgctctaaaatcatatccagccctgatggccacacccaggttaggaggcaccagtaatatcgctgtagagggcccaatgtttgcattttgtactttgccgtccttaactcttgatacaataaaaactattttttcatct

SEQ ID NO: 261806 - DNA, 145 bp, Homo sapiens
aggcaggagcctcctgggaggtaggaagcagcagccttgtgggagcagaccctccagaccctcaaagaccaccccaggcatgtggcttcagcacccatgcccagcatccacttccggcctggggccccgaaacatagggattcct

SEQ ID NO: 261807 - DNA, 577 bp, Homo sapiens
tagccaggtgtggtggcatgtgtctgtaatcccagctacacaggaggctaaggtgggaggatcacttgagcccaggaggtcaaggcttcagtgagctgtgatcgcaccactgcactccagtgtgggtgacagagggagaccctgtctcaaaaaagaaaaaaaaaagagaaagagaaaaaaacatcagaggattaaagaaaaccctggttaattaagtcactgaatataattaaataagcataatttgtagttaggaacacagagtttaagctgtccatcatggcacccttatagtaccaggtacttgggaggctgagacaggaggatggtttgagcccaggagttgaggactatagttcaccatgatcacacctgtaaatagctactgcactctagcctgggcaacatagcgagaccgcatcaatataaataaataaattttttttaaaaaaccacagagtttaaagtcagacagatttatggatttggaatctcagctttatacttcctggctatgtgaatttaggcaggtcacttaagatctctgagccttactttcagcaattcccttataaag

SEQ ID NO: 261808 - DNA, 596 bp, Homo sapiens
tagccaggtgtggtggcatgtgtctgtaatcccagctacacaggaggctaaggtgggaggatcacttgagcccaggaggtcaaggcttcagtgagctgtgatcgcaccactgcactccagtgtgggtgacagagggagaccctgtctcaaaaaagaaaaaaaaaagagaaagagaaaaaaacatcagaggattaaagaaaaccctggttaattaagtcactgaatataattaaataagcataatttgtagttaggaacacagagtttaagctgtccatcatggcacccttatagtaccaggtacttgggaggctgagacaggaggatggtttgagcccaggattttgagaccagcctgtccaacatggtgaatccctgtctttacaaaaaaaaaaaaaatacaaaaattaaccaggtgtggtggcgcatgcctatagtcccagctactggggagggaggctcaggtgggaggatcacctgagcctaggaggcaaaggttgcagtgagctgagatagcaccactgccttccagcctgggcaacagatcaagaccctgtctctaaataaataaataaataaataaataaatgagagga

SEQ ID NO: 261809 - DNA, 853 bp, Homo sapiens
cagagatggaagacattgatatgtggtagatcattttgtgttgttacggtgtttaacaatgtttatcagtgcctactatcttccaggcatagtggtgaccaagccaaaatcattaataagtgatgatacaaaacattaataagtgatgataccaatcatattttgagaagcagtgattcttttttgacagttttgttattggaattatccttattttggtaatggtttttcatggtgccttctaccttggcattcaaatggagtacgtatagtgacataaaacagattgttttgttcagggtggacaaagcaattaaggcgtttcctttgcagtcagaatagctgggttactttcagctgccgtgtcattttggggagattattctatttaagcctcagtgtcatcacttgtaaaacaggaattaaaaagagtacttacaattttttgattgataagagaattaaatgagctaatatctctagtgactggtacatggtaaacactctgtcagtttttattgtatatcattcaattactgtgtttttacaagtttgcttataaagcctcaaaaggtggtttatctgagtaaattacaactgtggaacttcagagttggaagacacatgatagatcattgtgtactgttatggtatttaaaccatgctctggggagccccgatttaaactgttggagaaactcctgcattgctttgagctgttttgcctaccaggattccatgtgcaattttattagttctaaagatgagaaactgaaaagggcagtgatttgtccaatatcatatggcaggagtcagtggcagagccaaggtattatagttatctgcttttcta

SEQ ID NO: 261810 - DNA, 733 bp, Homo sapiens
tttgcatcttaagtctgaaaattggttgaggttccacaattccttattgtgctaatgcaggtatggcgtcggttcaccagactgtttgtgaatcaagtaggacattaatggagtgcaatggactgaatgtttacattccgccaaattcatttgttgaaaccctaacccccaaggtgatggctttaggagatgaggtctttgggaagtgattaggtcatgagggccaagccctcatgaatgggaatagtggccttataaaagagacttcagagagattcttgcctcttccaccacgtgaggacatggccagaatgtgctgtctatgaggaagtggacctcaccagacaccagatctgctggtaccttgatcttgcacttccaaggcttaacaaatgtgaaaaataaatttctgttgtttgtaagctacccagtatatagtattttgctatagcagcctgaatgactaaggcatatgataattacctgtttcagttctagggataccatgatcaactattaagtggaatgttaaagatctctatctggctgtgtgcagtggctcatgcctgtaatcccagtactttgggaggcccaggtgggaggactgcttgaagccagggattcaagatcggcctgggcaacaaagtgaggccctgtctctacaaaacaaacaacaaaaattagccaggtatggtggtacacacctgtggtcccagctaccttcctcatcttt

SEQ ID NO: 261811 - DNA, 479 bp, Homo sapiens
  misc_feature (136)..(136): n is a, c, g, or t
gtgtgtgtgtgtttttgtttttagagacagggtctcactctgttgcctagcacatccatggcacactgcagcttccagctccttgggtcaagcaatcctcccacctcagcctcccaggtagctggcactagaggtncacaccaccatatttggctgaattattattattattgttaggtattattagtagtagtagatatggggtcttgctttgttgcccaggttggtctcaaactcctggcctcaagtgactgtcgtgccctgccctcctccccaaccccttaccagctgtgtgacttttcagtgcctacctaacctctctgggcccccatcttcttctctgcaaacatcaaaatactgacctcctactgttgtgagaattcaatgaattgatacacagaaaacactgggaacagtgtctgatgtgtagtgatagtcaacaaatttagttgaatgatctttattattgcaagactttt

SEQ ID NO: 261812 - DNA, 403 bp, Homo sapiens
agtagggagtgctgattggtcaggttggagatggaatcatagaggagtcaagtgagttttcttgcttgttgtcttctgttcctggatgggatcatagaattggtggaaccagattaccagtctgggtggagtcagttgatccatggagtgcagggtctgcaaaatatctcaagcattgatcttaggttttccaatagttatattttccccaggagcaattttgggaggttaagaatcttgcagctggaggctgtgtggtcactaaaccacaatttctaatcttgtagctaatttgttagtcctataaaggcagaccggtccccagacaagaagggtttttttttttttttttttggaaaagggctattatcaattttgtttcagagttaaactataaactaaa

SEQ ID NO: 261813 - DNA, 409 bp, Homo sapiens
catcccccctacctcccagtggccttaagtgctttccagagggtctcccacaaagccttgaggtctccaggcatggatggagcagaggtggtggatgggaaagaatgaggggatgaggctaagggaaccctgtgtcgaggggggtgaatatgggatacccccctgcaatccccagcttaagcagtttcttccatacatactcccgattcaggaatttgcaatacttgccatctcttttgggaagggcatttcaaggatggggaggaaaatgtttgggcatgctgagggcatcagggaagagatgacggctattcctagggacaagaatatctgcatggaggcaactaaaactgcacatgatgaggctaagcatatgtcatctatatcaaagaaagaaggtgctgaagca

SEQ ID NO: 261814 - DNA, 821 bp, Homo sapiens
ttggttggatagctgaaggtggaatttctgggtcctatgatagttttttgtttgactttttgagaaaatgccaaacagtttttcaaactatatgcctagcctaactttgaactgatctaatttagtcaatttcttgcaaattgtttgctatcttcatagttatttgggctatgaaagtagtggttctgagatctgatcaattttgcatttgattattagaaaattatatattgttttcaatttatatgtgatcttaaaacaccgctcattttcccccatatacagttctttattgtattttgtaaattgggcttttcgatgaagaaattcatatcgaggaatgtttaaagaaagccaaattaagtttaaaatgccaatgcatgctgattattgtcaaagtagtaaagaaaactccaactccacaactcataaacccctcaaatagcagaatttaaatatattatttgttaaatagaaatcctttattttataattgcaaaatggccctataaattgttatttcaatgtgcattttaaataaaagcgttcgggcaaaaatgcgctgttctcattcactagagcctcacatgcaaagataagttatctaagtgaagcgtctggaaattatcgttcagacttgggtcctgcctggggaaggtggtgactatgtgccctcccttgatggtgtactccgacttcagttaaagatagatctgttgcacaaacaaaaatgtttcatgaaatgctctgaaagtatctttaggggcatgtgtgacgttagtgaaaatgaatcatctttttagcattcagtcgttctattt

SEQ ID NO: 261815 - DNA, 314 bp, Homo sapiens
cggcacgaggcaaaataaaatctgtacaccaaacccctgtgacatgcaatttccctgtatttcaaatttgcacttggacccctgaacctaaaataaaagttaaagaaaaggtccttggtgatataaaaaaatccagatgcccaggtccatcccagaccaatcaaagtaaaacttccaggagtaggacccaactaccagtatattaacaagctctctaggtgatcccaatgtgtagccaaagtgggagatcctgttagtaaatgtttagtgtgattgatttccctggcggagagtgttaggttagaagaaaagga

SEQ ID NO: 261816 - DNA, 472 bp, Homo sapiens
actctgactggttctgacaaataggctgtaacaagaagggaatgatgggtgatgctttcattctgggtcgatgaaaacctcatggaccatttccagtctctctcccctggatggagagtacttccaatggtgcagacacttcaccttgcaaagggcggttggcctgatgcatctcctgcatcagaagtgaactgccaatggaaaacaaaaatgactttagtgtattcatcagtgagatgttggggttctttgttacctgaaacaaagcacagcctgtctgatcctgttcaacttatagacagaccaatagactccaagagtgcccagaaagagatctacccatgtatgaacaattgatttttcaacaaaaagtgaaactgcaaagtagtggagaaaggacagccttggtccaactgaatattcatttgagagaaaaaagtagaacttgtctctactgcatgccatacacaga

SEQ ID NO: 261817 - DNA, 369 bp, Homo sapiens
ggttggattgggtgagctctgattggttggatcaggtgagctctgattggttggttcaggtgagcccagaaagtatcccaggtgcaagggtgcggttttggggggactctgtgtttgtatgacctatagacagcaaacggccgctgggctctattttagccactcaggatccaccttgaaggactggctctttcagcttcaccactgttcccaggagtggccgtctctcatccggcgatacctggtcttacactgggctgagaatcgcattcacgcttattcttatactttacggtctaaaatgctttgctgttagctcttaggtttaaatcccagtcctacttattaaacatggaatttgagtaagta

SEQ ID NO: 261818 - DNA, 527 bp, Homo sapiens
ctcctgcccggtgagcttcaatttggtggggatggctggggcagaaggagcctgtgatgggaggggttgctggggttctggggcccggagaccagagggaagaagagaggccctttacacatgtgaatgcagaccccacgtgcctccttctccaggtgatgtggctcagacctcagacaaccctgtgaagatagtgccactagccccaatttgtagacaagaaaactgaggagcagaaattaacctgcctgaggccgcataaataatatgcagttggctgggctgggctggcaagcactggcctgtggaactttaaaactaaagctcgtgctgagttggattacacgtttgaatgttctattttctttcttttcttttgttttaaccagaagactgccttgttcctctttctcattctctttccttccctctttccatcctccatttccaaacccaggaacaaaccatgggaggcagagcaaggggcatggttcccattttcaggattgtaaagcaaggctcatcga

SEQ ID NO: 261819 - DNA, 522 bp, Homo sapiens
atatacttgcatatgcacaggcacaaagatacctgcaaaactgttcattacagcatcgtttaataacagggaaaaactgaaaccagctaagtggctaccaccaggcaacagttaaatgtagtatgaagcaattacataagatgttatgcagtcatttaaaaggtagatttctgtaaggggatgtggactgtcttgcaagatgtattgttaaatgaaaaaggcaatgtgaaaaatggtgtagatagtattctagtatgtctgtaaaaacagaaatattctttatataaattttcttcataaccacatataaattgctctattggctgttcctggaattaaaatattaaaaaattataaatagtggttgcctctggggaggtgttgtggggctgcacatgtaaacagggaatatttgcctctcatcatcgattgatttttattattcaacttatttgttttaaacacagcatttctttgtctattataattttagatatccaataaaaaataaatattataaat

SEQ ID NO: 261820 - DNA, 690 bp, Homo sapiens
agggggtggatagaattttgtgtggaggatttagatcctaggaaaagaggtaaatgaaggttgcctgggatgagccctctgcctcccagtttgccctgggacactccctatcacgtgcaggcccgagctgttcccaaaaggcgttaatgagagtgcctggcaggtgtttatacatctagaccctaaacatacttaaggatgtcttttggccatttctgtggtcattgccattcttaaaagagttgctttaaataagttaaatgtctgttctgcacccacatcctagaatagttaagttgcaattagcacctgcaggtgcatctcatttgtacacattttcttaactgaatcataaaaacacagcatcagaaaataatgatctgttcttcaggcctcagtaactaacattaaggccctgaaaaaaaaagcatattagaaatagcttttatgagaaagcttagataaggaagcatcctcaaagtaaaaactagatacctgagaaaactggactggttcaagataatatggaaggaaaagtcagctaaatgctcttgactggagcatctggtgggatgttgcatttgagttcacaaaaatcccagacttcagcactgtacaattcatccatgtaaccaaaacccacttgtaaccctaaagctattgaagtttaaaaaaagaaattaaaaacta

SEQ ID NO: 261821 - DNA, 354 bp, Homo sapiens
aatttccttgttttatccagcctattgccaagttatggactgagattttcgatgagacaacttgctggagagtccctatttttcagggactttaacaacatgcatttgacacataaatatttgatggcttagcaaataactgatccataaatgggagggcaatttctggccttgttctttaaatcaagagttctgcaaattttgcaagtccatgaggaagagcctgaaaaaaagaaaattggggtgaaagtgaccatggaagatacaggaaaagagagagagggaaaaaaaatttaaaaagagggtctgaagatcaagcagccccaagcaactctcctctggataaaaaaaaaa

SEQ ID NO: 261822 - DNA, 568 bp, Homo sapiens
agactgaatgatttgtcttctctgccaaactggctggctttaccatattgatgacttgcctatttgttcatttccccaccataatgtaggctccatgagggcattagtggtgtgtttgcattagtggtgtgtttttttgaacatccttgtaccctagagttaagtgcattgtagaaacttatcttcttaaaggaatcgagattattgctgggtggtcaaattaaaggtgattttaaacaaacatatataagaaaaatgctaataaagacatactggcagaattcattccaaaaagtattaagacaaggaaggggactttaaaatgaaaaagggtgcaaatgagatataatttatgaattgttatgtgcatcaaaatatatagcagcaatgtttgtaaagcaaaaaactaagggaggtacaaagaaaaataacggacaaaaacacagacaaagcacattaatactgaaaattttagttcatttcttttagttcatatataaaaatcttcctaagtaacaaaagttcccattcctcctcatacaccccaaaaataagcaggacacataat

SEQ ID NO: 261823 - DNA, 396 bp, Homo sapiens
ccgaggtcccgtgtggcaccagggtatgtcagggctgggggcaaacattttataggcagagccagcaaggagagctgtgctgggcccttctggaagggaaagcaggcctaggtggggtctgcatggtggaaccctgcagagagcattgctgaaagagcctggcggcatggcccgtgaagcggtttctgtgtcagggatggcgtgtctagctacagaatcatgcatgtgctgcacagtttcctttcttctttgtctgggacaagctgcagagggtttctcttctgcttttcaaagagcaagtggctacaaacagctcttgcagcatctttttataaatgacagaactgtggttggctgtgaataaggttcagttctgcagtgcccatcacatggtta

SEQ ID NO: 261824 - DNA, 514 bp, Homo sapiens
cttgaattgtaggtgtgaaatcttacaatctttcagaatgatttggtttgggggatggttggaactgcatggaattccttcagccaaaataatttttgtgagcacattcccaagctcacgatcatgttttgataagaaaaatccctttctccacaagttctcaggtcccactcattggcccctgccctcatttctggaacctatgttaggcagttatgtggctcagttcttggtgatatgttttcaatttgagtcaacttgatgagagaaaaattactaaaaaatgggaatgagctgtgaggtgaacagggttttcctatcaaagtggaggtatttttaaaagcatttattatttcaaactcaaacatttatagaaagccatgagtgtgaagtgtatgattaccagttgtggcttgctgcattgaaaaattcaagttcataggaaatatttactgaggctctggtttgcaagcagtttgttcaagagaacaatttggtccagaaggcatgtcag

SEQ ID NO: 261825 - DNA, 730 bp, Homo sapiens
caaacgcactgtcctgaacctctggtccttgatctcctcaagcacaggagccgcctgtcccgctgttccctgcctgggctcccttctttgtctctcgctgtctcttacacaaacttggtctttgtgactccagtctgttctccttttcttcctcttgcctctttggtgccaactctttctcccctccaaccccgtgaagtccacacaggccctcatttcatattccccctccttttcccatcatttctctaagctgtcatgctcaacagtgggtaatgagctgacacagggaggccttctgccggccttcttcccaaggcatttggatggtaaaagggatcccagcttcaagacttaattccctgagtcgttggtgggtaattttttttttttttttttttttttttttttgagccagagtttcgctctgctacccaggctggagtgcagtggtgtgatctcggctcactacaacctctacttcccggtttcaagcaattctcctacctcagcctcccaagtagctggaactacaagcacctttcaccacacctggctaattttggatttttagtaaagacagggtttcaccatgttggccaggctggtctcgaactcctgacctcaagtgatccacctgccttggccccccaagtgctgggattacaggcatgagctactgcgcacagctttggtgggtaatttcaaataccaaccataagtgggtcct

SEQ ID NO: 261826 - DNA, 644 bp, Homo sapiens
gttacaagggcaggtcaaaattaggcaaaagaaactttgatgctagattatctggcagtaaaacattcatttattaaacaagcagttgttatgagccttcttctctgtacgttaagggctgggaacagcaaagatggggaggactttgttctggaggtgctccagtgaggggagaaaaacacataaagataccttcaggctgggcgcagtggctcacgcctgtaatcccagcactttgggaggctgaggcaggtggatcacaaggtcaggagatcgagaccagcctggccaacatggtgaaaccccgtctctactaaaaatacaaaaaaaaattagctgggtgtggtggtgtgcacctgtagtcccagctactcgggaggctgaggcaggagaatcgattgaactcaagaggtggaagttgcagcgagccgagatggtgccactgcactccagcctggccgacagcaagactgtatcaaaaaaaaaacaacatgctgtggctgaatagacctatgggtgacctggagaagtgtgaaaaaagctttcccaaggtagtggcacctaagtgggaacttgaacaatggagagtctgcaaggcgagaaggagcaggagcttcagaggaagccatgggaaccaaaggatg

SEQ ID NO: 261827 - DNA, 135 bp, Homo sapiens
ggatgaagaaggaggggatgaactcactttaatttaggctgaacccagaagaatttactaaccaacaagcaagcaagtgagccaccaaagtaaatgctgtcaaccttaaataactacaaaggccaaaaaaaaaaa

SEQ ID NO: 261828 - DNA, 460 bp, Homo sapiens
tcacatgtttgctgttatcaagattgttgtatatgtgaatgaaatgatacgatgtctcagatttgctttaaaataatagggaggttggggaagtgggttggggtacagacgaaacaggagtaggtgtgagttgataatgttgaagttgagtgatcagtacgtgggtttattacactattcttttcacatttgctttgaaactgttcataaaaatttccataataaaagttctatatatatataaatatatacatacatatgagaaaatgatgtttatagcagagcttcactagacatggtatgtagcatgtagtgcacaagctgattttaagtgatattcagatggccttttaaatttaattattatgtatttaaaatttaattaattatagcaagtgatatgaactgtgataatgcagaaggtttccttttaaaataaagttcagtcaaaaaagtgaga

SEQ ID NO: 261829 - DNA, 434 bp, Homo sapiens
ccctccacccttatcactcagtacccacctgaccctacttatcttccagaggcaatcactgttctggattctctcaccacgaggaagtcaattcatgagagactgctccacaaagcttgctggggagagaagaagcgaacagattcaggaggcagaagagtagagtgagacctccatgtaaatatgtccaagctggcccgcttgaaggatggtaggccatgcagaagaaaaccaaggcacccagaaggacatcctgccaactgcgagatgtttgagtgagaccattctgtcagccagtcaccagccagccaaccagctaatgacagatgcatgcataggctccagagagatcagctgagttgtcccagactacaagaaccagccaacccgcagaattacaagaacaataaaaggttgttttcttaagccactaa

SEQ ID NO: 261830 - DNA, 400 bp, Homo sapiens
tgccgcgtgcccacccagctctttttgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaa

SEQ ID NO: 261831 - DNA, 630 bp, Homo sapiens
tgctgcaggcccaccatcagcagcctacatttgctcccctcctgccctctcttcccaggaagcccctcacctgtcacttcctgaagaatatggaagccaaggaggtcttcttcaggcattcctctccacccatgcacttcctccctccctgccagcttcaaaggaattgatttccagagagacccttcccagttgccccacctttccgtcagcctcttccaggaactgtcctctgacatctctctgtctaggtctccttgtcactcttgtgcacaccaagactgttctcccttttcctgtcagccactgagtccactcagatatcttctgcttcccaaaattaaaattacaaaccaaaacagagacagcttccatgaccttacacattgtagacacttggctacagcagtgaatgacataaacaaagtccctttcctcatgtagccctcatgctagtagagtgaaacagataataaataaactagtcaaatgttcagcatgtgagttggtgatgacagcacggtgcttcatgcctgtaatcctagtgctttgggaggccgagatgtgaggatggctaaggtcaggaatttgagaccagtctgggtaacatagtgagaccctgtatctaca

SEQ ID NO: 261832 - DNA, 614 bp, Homo sapiens
ggaggcctcaggaaacttacaatcattgcagaaggcaaagaggaagcaagcacgtcttcacatggctggcaggagagagagaaagtgaaggggaaggtgccgcacactttacaacagccagatctcgtgagaactctttatcacgagacagcactaggggggtggtgccaaaccattagaaaccatccgcagtatccaagcaccttgcactaggccccacctccaacaccggggattacaattaaacatgagatttgggtggggacacagagccaaatcatatcactgtttattcttgttccacttgagaatgctgtgtctttgcagggttagggtgatatctctgccaaagggttgtccctggaatagccccactcatccttgagaaacgtggagaactcattctattccactcacccggaaagagtaaatactcttctgccttatgggattaaagctctttcccccgtgtgtgtgtgtcttacctccttgacaggaaaatgtctccatagcaggcattcttgcctacctttgtagctccagcagcccctcatagtggccttgcagaagctgcatgtttaataaatagttgatgaagaaatgatcaaaacaga

SEQ ID NO: 261833 - DNA, 853 bp, Homo sapiens
aagaccttgggaataaaggacaaccttacaggcttagtcctcctgttcttccactgtgctccttaaaggaaattcaattgtctactgataaatttttcagaatggaaccatctgaaattaccaatggttgttttctttctattttaacaagggagtaaatgcttctttaattgcagcgggacccttctgagacagtgtctgtgaatgatgttttggcccgagctgcagccaagggtctgctggatgggattgagttgggtaaatcatcaaaacgggagaagaagaagaaaaaatcaaaaacatcattgacaaaaggtgccactactgataatggcatccaaatgaaaattgctgagttcctgaatcgagaaactaaagccagtgctaatctatcagagactgtaacaaaaccacctcttccccagaaaaatactgctcaagtgggggcttcctcacagaccagaaaacccaacaagctggccccccatcctgcagtgcctgcatttgtgaagaacacttgtccctccagaccgcgtgaacggcagacacacttcttaagacctcggccagaagacagaatggttgctctgaaacccatcgagattgttctgcctccagtctttatgccattttcaagtccccaagggatcagatctcggatgccaactcaacatttgtactgtcgttgggttgcacccaaggcacttgtgcccacctgccttcccacacactcactatccagaaaagaggaaaagcctaaagatgacacaccttcctccctactcaggcctcctcggcgatggctttgattgtcttgtgttttttataggggccaaagagcagttgatttttt

SEQ ID NO: 261834 - DNA, 445 bp, Homo sapiens
tagaatacgtccgggttaggacgtactgggatgaggaacgtcactgggataggaacgtcactcaactcagctgaagctcgagggcacctctgacgtgaaggaatcctatattcaggctccccaccctaagaaatcttatcccacacaccagaaattccatcctagaaaccagccagcctcattggtgattgtttagctccatcagaattggccatctcttgagactcacctccttagcttcccaggccaagggtgaatcctgcttttcaggagccagcaggatgacagccttccagtctagaaggttcctaggccctgcaaggactgccttggttctgcccccagggacaagatgaaacactggttggagtttgtaagtgaccaactcagaggagggctattctgagtcgacccgataaagaatgttttcttgtagcagtgtgca

SEQ ID NO: 261835 - DNA, 463 bp, Homo sapiens
tctgccaatccccagggcctaacacagagcctggcacagagtctatgctctgtaactgtttgttgattgaaagaaggtgacaactcagctgaagctcgagggcacctctgacgtgaaggaatcctatattcaggctccccaccctaagaaatcttatcccacacaccagaaattccatcctagaaaccagccagcctcattggtgattgtttagctccatcagaattggccatctcttgagactcacctccttagcttcccaggccaagggtgaatcctgcttttcaggagccagcaggatgacagccttccagtctagaaggttcctaggccctgcaaggactgccttggttctgcccccagggacaagatgaaacactggttggagtttgtaagtgaccaactcagaggagggctattctgagtcgacccgataaagaatgttttcttgtagcagtgtgca

SEQ ID NO: 261836 - DNA, 340 bp, Homo sapiens
tttttttttttttttgacagagtctgggtctttggcccaggctggactgcagtggtgctatctcagctcattgcaagctctgcctcccgggttcacgccattctcctgcctcagcctcctgagtagctgggactacaggtgaccaccaccacgcccggctaattttttttgtatttttagtagagacggggtttcaccatgttaggatggtcttgatctcctgacctagtgatccgcccacctcggcctcccaaagtgctgggattacaggcgtgagccaccgcgcccggctgtttctgtattttttgaaaagcctcacgtatttggactaatggctaaa

SEQ ID NO: 261837 - DNA, 310 bp, Homo sapiens
taggaatccagggtcctagtggcccaggtcaggagggagggggacagacagggctttgtcaccagagaacagagtgccagcttctattttctgattccagttttgccttggccccagggtgagcttgctgaacattattagataccctaatgtcagcatctaagtcccccattttattttattttactttatttttattttattttattttatttatttttgagacggagtctcgctctgtcgcctaggaggttgaggctgcaaggagctatgatcgtaccactgcgacagagcgagactgatatactta

SEQ ID NO: 261838 - DNA, 408 bp, Homo sapiens
ttcagttcctgcttcaggtgcagaaacatagctatttccagtgccagctgttgagccagtgccagcaccaggggcagagccccttccagggacagcactggagctagaggaagctccagagccctcctgccgctgccctgggattgcacaggaccagcccagtgagaagctgcctgacttcatggcacctcctgtagagccaccggcctcagccctggagctgaaagtgtggctggagctagaggtggcagagagggggtgaccagcacagctccagccagcagctcccacactgctcccagtcctgggcacagtggaagctgtggaggcagagaccagggtgtgcaacctgggctcctctgcctcactggagagggacttctctcattcagcaggcacagccctgct

SEQ ID NO: 261839 - DNA, 446 bp, Homo sapiens
cccacaatggcagtggcagcagatggaggagatggagcagaaggcagcagagggcgtcccaggtagtacgggcaagccaccttgtgcatgacttgtgtcttaggtgtgactgtgtgtcctgggatcagttctgggtggtcagaaaagtttgaagccagatgactccactgtcaaaaaacctctgtagagttttctaaaggtgaaagtatccagatgaagcagggctccttgaaggaatggctgcttctggagttggagcaggggagatacaagatgagcctggagctgcttgtagcaccagaggggaaggaggtggtcacaacccaagaggctgggacatcttacatgggcttctgagcccgagcctcagacaaaccacacgaccttggattacagcccctggagtcaaataaatatacctgagtccgtagtgacctaaataaaca

SEQ ID NO: 261840 - DNA, 429 bp, Homo sapiens
ctttgctgtttttaaagccacagtttaaaagtatttagctattctcaggtgatatggtttggatgttttgtcccctccaaatatcatgttgaaatgtaatctctgatactggaggtgggcctagtgggaggtgtttgggtcattggggcagatctctcatgaatggcctggtgttgtcctcaaggtaatgaatgagttgttgctctatgggttcacacaagatctggttgtttaaaaaagactggcacctcctccctctgtcttgctccctctctcaccatgtgacatgctggctccccttcaccttctgccatgattaaaagcttctgaggccctcaccagaggctgatgcaagcactatgctttgtgtacagccttcagaatgttgagtcaaataaatctattttctttataaatcaccctgtctca

SEQ ID NO: 261841 - DNA, 690 bp, Homo sapiens
gttcttagcttctttgtagtgagttagaacataatccttcagctcagtgaagttcattattacccatcttctgaagcttacttctgtcaatttcatccatctcagcctcagcccatttctgtgcccttgctggaggcctgtgcgaacctcctgaaggagaagaggcactctggctttttgagttgtcagcatttttgcattgattctttctcatcttcgtgggttcatccatctttgatttttgaggctgctgaattttgatggggttttatttgatgccttttttgttgatgtggctgtgttctgtttgtttttcttttagcagtcagaccactcttctgtggggctgctgcagtttgcttgcagtccactccggcccctattcgctttgatccctcccctccctggagttaacatcaggggaggctgcagagagcaaagatgtcaggctgcttttttctcggggggctctgtcccataggggcactggcctgatgctgactgaaacactctgtatgaggtgtcttgagactcctgttgagaggtcccactcagtcaggaaaagtggggttagggacctgtttaaataagcaatgtgcctgcccctttacagggtgggtgtgcttcacttgggagaatcaccctcatctgggctaccctgattctctagagccagaaggcagaaaagac

SEQ ID NO: 261842 - DNA, 610 bp, Homo sapiens
cgtcccttcaacggtgttctgctctctactcaactttatttgaaaatgttgcagcttcactcctgttagaaaaggaaatcttcatattttattaatcttagccgccagtgtactcttgtgggtgatgtggcaattcataatgtccagtgaatctggactctcttactgattcctggttttagtgtgtgtgtccgggggagtgtgtacctatatataaaggacaagtgtgatatggaggttttactcatgttgcccgggctggagtgctagtgacacgatctcggctaactgccacctccgcctcccaggagaatggcttgaacttgggaggcagaggttgcgatgagccaagatcacgccattgtactccagcttgggcaagaaaaatgaaactctgtctcaaaaacaaagaaaaaagtaaaaagagagttaggcttaggcttaatggaattttttttatcttctatctagaccaattaaactttcttcataacagcagcaagattgtttagctttttatcattcatgtattcactggagtagtactttaaatttctttccagaacacttcctttgcattcacaacttggctaagtgtttgttgcatgag

SEQ ID NO: 261843 - DNA, 830 bp, Homo sapiens
aaaaatttatttcttcagaaataaattagtcttaacttactgtaacgtttttattttataaacttaattttaaaaaacttttgactctttcgtaataatagccaaaaatacaaacacattgtacagtcatataaaagtattttcttcctttattcctatttttttcctatttttaatttcttttatttaaaaaaaaatttaaaaatgaagacacgaacacatttattagcccagacctacacagggtcgggatcatcactatcattgccttccacctccacatcttatcacactggttactcataaaatattatcagctggaatttttattattatttcctaatttgcaaatgcggaaagagggtcagaatagttagacattttcctaacgtcttgtcttggagcaataaatgtagagctgggatttgaatccaggcctgtgtatctcccaatgctgaaccctttctgcaagataagacacttggaaattaatgcttgaatttagtttgatgttccagtggctgtatgtttatgagactaaaaaataaaatgccagtcagtgtggaaattggtatctactgaattgaatgctttaagttatttaggttttccccaccttccctgtccctgaaacaggtacaaccaaaagcttcttattctaatcaaactaacactaaattatttttcttctgaatgatgactatacctttcccagacaataaagtcttttattttctgtaatttctcattctttctttttatacactacaaggttgttattattgagaattcaggtctattaataaaaacagttaaatttattctgtaca

SEQ ID NO: 261844 - DNA, 340 bp, Homo sapiens
tttttgagacagtctctgttgcccaggctggagtgcaatggcgcgatctcagctcactgcaaactccgcctcttgagttcaagtgattctcctgcctcaacttcccgagtagctgggattacaggcaccaccaccacatctggctaatttttttatttttagtagagacggggtttcaccaggttggccaggctggtctcgaattcctgaccttaggtgatctgcccacctcagcctcccaaactgctgggattacaggcctgagccaccatgcccagccccaaaatctttttgatgaagcctagcatttcatggtttttgtttttctgcaacagcaagt

SEQ ID NO: 261845 - DNA, 449 bp, Homo sapiens
gataactaaaaagcatagaatgcaaaagtagggagggccctgccctcctagccaaaattgcacataccttccctgctgcagctggtgaagcagctaactgcatgtgtttccctattgcaggcctttctggtgggtttacctcctgagaggaagaagtgagaaataccctcgctcctcttaattacacaggaggcaggtggagaggcattgttgtgcatgtgtggctcagttaaccccacttgtggcgcaataaatatgaaattatgacaattcagatcatctaccttgacttcctcaagtaggaatacaggtgtagaaagaagggttcaaagtgttcatgacaaaactgcctctcttctgggcttcttccctgtgggtttcttcttagagcagcactctccagtaatgcaaatgaatatgcaattctgtgttttctgatgactgcattt

SEQ ID NO: 261846 - DNA, 384 bp, Homo sapiens
atgtaatactcgcagaatttggtgttgccacttgtatgtgtgttctcagagttcgtgaggtggacttatatgtatttgataaaaatagtttgtggttctgtgtgtatttgagtttatgtggcttctgtgttttgtattctgggagatgtgggaggttcagtgcatgtatttggaaacagagaggctgtgtaggttgtgtttggattcaagaatcatggattcctgtattttagagctgtgggattgtatgtgattctttttctgggtgatgcatgacacaagtgttgtataccttgtgatttttttttttgagcctatgcctataggattttcattatgtactgttaacaaatctactgaaaaggattttctttaaaaaataac

SEQ ID NO: 261847 - DNA, 368 bp, Homo sapiens
gaaaatgttctataattgactgtggtgattatctgtttgcatctttgaatatactttactgaattgtacacttaaaagggatgcattgtgtagtgtgttttattctgatatagcttttcaaataaatatgacttcagatttttgattaatctgttaagcatactaagagtttccagatataccttaatttacatcactttttattgttcatttttgtatcagtgaaaatagggattcaattaccttaggtatatcatagtcgtttacatttcaaagttctctgcgaacacaatctgtaacctatttaaaataaattttcctgtagtgtgaaatgtacacttcagagtttaattgaacatatctcacag

SEQ ID NO: 261848 - DNA, 621 bp, Homo sapiens
aggtagaataagaacaaataccccaaatgaatgaatggaaaggcttaatgaaaagctgaaatcatggaataaaaaaccatacaggtttttcatcaaaatctagtcctttgaagaaaactattattcattagactttgtcagtgcctctactatattataaggagaaatggaatataactatatgtttggagatattttttagtattaagtatgtgaactctgttagacatgatttttatatgtgtacggtttttttctaggaaaacattattaaatatgattaagtttcaaaaacaacccaaaaagttcaaaaaatagaaaaaagtatcatgtaagatgaggttgagcacagtggctcatgcctgtaatccaaacactctgggaggttgagacaggagtatcacttgaaccaggagttccagacttgcctggacaacatagggagacccccatctctgcaaaaaataaattagccaggtgtggtggcacatgcctctggtcccagctactcaggaggctgaggtgagaggactgcttgggcccaggagtttgaggctgcagtaagctgtgatcaccccactgcactgcagtcggtgatggagcaagaccctgtctaaaaca

SEQ ID NO: 261849 - DNA, 538 bp, Homo sapiens
caccagagcacgagtgacctactgactgaaaacccccagggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagactatgagctcagcccaggcagtgctggagctagaagagcaggagagggaattgtgtgctgtatttcaaaggggtctaggatccttcaaccagcagctggctaatgagcaaaaagcccagcaggattacctgaattcagtaatctacaccaatcaacctacagcccagtatcaccagcagtttaacaccagcagccgctaagttcaggatgtctatctctctctcccttctcctccatcaagctcacaggtggttaggagtcaaagagaaaaatgctgcatactcccaccttctaacctaggtaataaagttctgcactcaaaatcaagtcca

SEQ ID NO: 261850 - DNA, 654 bp, Homo sapiens
caccagagcacgagtgacctactgactgaaaacccccagggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagactatgagctcagcccaggcagtgctggagctagaagagcaggagagggaattgtgtgctgtatttcaaaggggtctaggatccttcaaccagcagctggctaatgagcaaaaagcccagtgagttctaggtggtagtggtggagataaatgccaagggagggagaggagggatggtgaggaaccatggagagagggaaagcatgtcagctgagacctctggacttctttcacaggcaggattacctgaattcagtaatctacaccaatcaacctacagcccagtatcaccagcagtttaacaccagcagccgctaagttcaggatgtctatctctctctcccttctcctccatcaagctcacaggtggttaggagtcaaagagaaaaatgctgcatactcccaccttctaacctaggtaataaagttctgcactcaaaatcaagtcca

SEQ ID NO: 261851 - DNA, 427 bp, Homo sapiens
gtagtcaaatgaagcctatggatccttttttaagaataatattcttatcaaataatatctattacctaataatcaaataatatctaatatcaaataatacctattataataaatgtgaaatgatatttaatataatatgtatcataatacatatgcattatgaaattcaacacgaaccaattatattttagtataggtatgaaagatatatactttttttttttttttgaggtacaggagagaagtctcactctgtcacccaggctgaagtgcagtggggtggtcttggctcactgcaacctctgactcctgggttcaagctattcttctgcctcaaccttccaagtatctgagattacaggcacttgccaccacgcccagcaaatttttatattttctgtagagacggggttttgccatgttggcc

SEQ ID NO: 261852 - DNA, 255 bp, Homo sapiens
tacagacgcatgtgtcccagtgctctggccccatgacgtgtgaactccacccaccatcataaagggcactgtctatttggaagtcccccggtccctagctgggctcctgggatgaagaggaggatagggagggacatggcgggtgtaagctagggtcctgttctgcctgctaccctgggctgcagggaaatgctggtaaatgtttaacaactgacacccttccccaccaaaaataaaaagccccaagttatagca

SEQ ID NO: 261853 - DNA, 289 bp, Homo sapiens
ttttttttttttgcatttttagtagagatggggtttctccatgttgcccagggtggtctcaaactcctgggctcaagcgatcctcccgccttggccgctcacagtgctgggattatagatgtgagccactgggcccggtcatgcgagacttgtttcacttaattttttcaatccggaaaatccatgtctttgttctcattttgtaagtgggggaaaggcagaggttcagcaaggttaagtcacctgaataaggtcacacagctggcaggtggtggagctaggattccag

SEQ ID NO: 261854 - DNA, 533 bp, Homo sapiens
ccatgctggagagactaggtacatcatgggccagcaactgagagaaaatcgggagcacataagtccaagtgtaagaatatggggtcagggtagtggaaagaacagttatttaactgtttccccagaaggtaaaaacatgccatattttctcagcctgagaaaaattcaggatcaagtctgtttcacttgagaaaatctttcccacaagaacttatggatatcatttttttttttttttctagaaaaagtctcactctgtctcccaggctggagtgcacaggcacaatctcggctggctgcagcctccacctcccaggttcaagtgattcttgtgcctcagcctcctgagatatctttaaagttttcttgtttctttcttaagaaaactctccctattctaatctccactcataattctcaagatggtgtacaaatattgctataaataactattcatcaggaagttccaagaaaggttctgttgggcaatagttgatataactcatgaaataaatatttactgaacatgtaaa

SEQ ID NO: 261855 - DNA, 533 bp, Homo sapiens
ggctgtgtggcctggtgcctgaaggcacactgcccggggcgccctggagaggcgcagtggcgctggcagccgaggttccagagcgcacggtggcgcagtggctggcggaggcctgcacgcagccgccggaggagttcgtgtgggctgtggccctgctgctgctgcagctgagcgcggccctgaagttcctggaggcgtggggcgcggccctagtcgagttgcggccggagaacttgctgctggtggcacctcggggctgtgcgacgacggggcccccacgcctgctcctcactgactttggccgcgtctgtctgcagccccctggacccccgggatccccgggcccccacgcgccgcagctgggcagcctcctccgagcgctgctcagccttgctgcgccctcgaccacgcctttggccgcgggcctggagctcctggcagcacagctgacccgcttgcggccctcggcgtcccggacgcggggcgcgctgcaggcgctgctctgggggcccgggcctgagctgcgcggccgc

SEQ ID NO: 261856 - DNA, 497 bp, Homo sapiens
ggagggagctcttaaagacctgtgctgatgtcttacgttgtgtctgtgtgaacttgatagacttgcagcctaaccctggagggggcagaaataaagtggtggctgaggaggagaaagtggcctgagcccagcaggcccctggatggcaggagcggctgccgctgagctgtccctccgctaggcccagagtcagctgactctgcatccttagctttttccttctctcctaaggcccttcacccagattgcctggtgccaagcagcttactacttcttccctctctcttccatgtgtggcactcccttccccttgtttttctttttgtgggaaattaaaggaacctaatggtgcttattttcctaactccatcttagtgtatagcctggaaagacacctctgctgggaagagactcctaagtccaggagccaagctcctgtcattgccaaaggctttttgcatatgacctgtgggaaaaatttagcccccccaccgcca

SEQ ID NO: 261857 - DNA, 427 bp, Homo sapiens
ggagtgcagtggtgagatctgggctcactgcaacctcggcctcccaggttcaagcgatactcctgcctcagcctcccgagtagctgggactacaggcacatgccaccacgcccggctcattttttgtatttttagtagagatggagtttcaccatgttggccaggatggtctcgaactccagacctcatgatccgcctcggcctcccaaagtgctgggattacagacgtgagccaccgcgcctggccaaaaaaaacctttttttaaaaattagccaggtgcggtgatgcacacttgtagtcctagctgtctgggaagctgaggaggggagattgcttgagcccaggagttcaaggttacagtgagctatgattgcaccttgcaccactgcactccagtctgggcgaaagagtgaaactttgtctcaa

SEQ ID NO: 261858 - DNA, 481 bp, Homo sapiens
atttggaatgacagtgccaactcccaggaactgaggatttactctgttattttggttttagttcttcatgtgagatggtaaaacttgaagagaaattccatggaagattgtattaatatcattaattgctagattatcagtagcaggaaatgtatcactagactgtgatagacacacacacacataaatatatacctactactttatggtagaaagacaaacagcctagttccatgattttccaatttttggagtgtttgcagtttgttgactttgttgctagtaaatctaatgtggtctttttcaacaatggaccttcggcgttcgctatttctatgctggtttgatgaattagttgataagtcggatattgtattctcaagatcaaaattgtatttctatgtcagcatgtcagtgaacatgcatttagagtgtgatggagaaaataaataaaacacatggataatctcagtgtggaaca

SEQ ID NO: 261859 - DNA, 531 bp, Homo sapiens
aatcgacatcaaatggcagtctcaacattcaattaaatggacccattgttatgtcccctagtgaaagtaattttcttttgcatcacgaaatctttgagctagcagagcccaaatctgtggaattggaaaataaaatatttacaagtgagatttacatgtaataatgagaactaccattctaactataaattcagtttatggagacattgagctctagattgagctctagatcagctaaatgttaatcactagatcagagcatcccatgggatagtagcccaacctcacaatgttgtctctcaactcttgctggaactgagttctcaacaggccaatccactcttttgggtaatgaggaacatggtaaaaatcagagaatcccatgggcatgaacccactgctttgctttttttgttgttgttgttcagaagcagtgttgggtggctcaccataacagtgaatgttgcaatgtaagtccgttgatagtagcagtggcaggatcgtagcatgcagggaaagcaaatctatatc

SEQ ID NO: 261860 - DNA, 310 bp, Homo sapiens
gtggttattatacaaataaaaaaaagtttttagtgcctgtgaggttttcatcaactttagtcatctggaaaattaactttgtcaatatgctcagtcctctctgccaaacaaatcaaggacaatcatgctttagtatctttccaatacatatcctgtcattctgttggactttcttattatagatgagaagtgattccttccttcagccttaactttgagcccaccacactaagagcatagttggaataattttttattttttttcctgagacagtcttgttctgtcgcccaggctggagtgcagtggcac

SEQ ID NO: 261861 - DNA, 344 bp, Homo sapiens
ttttctcagcagcatccttgagaatgtgcgacgtgactgggttcttgaaaccactgttccgatactgctttcctttgctaagtttaaattccagcctcctaattctaatgttttcgtgggaccttctacaatccttcttttctgtatgtcttgggcaggcaaaggggggtattctccactagcatgttgctaaagagggcctctaccctttaatgaaactgttttacctgaataagctttgaaaaagaaataccgtagttgaatattatgctgtcccatctcctcatcagctactctccacaactttaaaaaacccaattcttaattcttaactacacagccat

SEQ ID NO: 261862 - DNA, 448 bp, Homo sapiens
tcttgactttgatgtattttgacttctaattttatttggataaatttttattctctaccaaaatggagaaaaattgtgaaagtctatgattttgcagtatctagatttggtgaaatgttgaaacaatcacagatatagacaacttgaaagttttatcttgtaagaaattattgagcaaaagtgctttgaatgaaggtagaaagacagcacctatgacgatattggcctgaaatatttacatattttaatctaaaaaatgagaagattcttcatttagcagaacttacaggttcatcagtatctagagaggaaatgtgttctcagttaaaaacatatagtgaagcatcaattaaagttgtccataatttcaaatatattaaccataaaatgaagttttgaaaaagattgcagttttataaaaaaataactgtttaaataaaaaacgaaa

SEQ ID NO: 261863 - DNA, 480 bp, Homo sapiens
gtggatgctcagaaagtggggaaggaaggaaagatacaacggtaaaaggcttacacgtcttgacaggaatgtccagttcggctcatttggctggagtcgtactgcatggctgccattctgctctggcatcctcagacaagcacactgcccattagaggaaaaagtgtgaatataagtgttgagtcagaatgctgtagacatttagtaacctccttcacaggaaaaaaaaaagatggggggaatgacagaaatccaaaaactagtagagcttccacttttcatttcagaagaaatcagttgctctcctataaggaccattactattaacaaaacagagaccttagaaggaggcattgtttatttattatatattttgtaatgttattaccaatcttgttatactctttcttataccctacaattgttagcagaaattattttaaattaataagatcctgcatgcttttccttaaaaaaaaa

SEQ ID NO: 261864 - DNA, 929 bp, Homo sapiens
gcaatggaacatctgagttttgtgtaactgatgtgaaagctgctgatttagaatactgcagcaataagactagatattgctttaaaggagaatgcagagatagggacagacagtgcgcacagttatttggaaaattttctaagtctgctagtgttctgtgtacagaaaaagtgaattttctaaatgacaaatttggaaactgtggttcccgttgtcatttttatgatattctttgtggaaagattgtcactggacacattcagaaacagtatcaatgacagactttgatatacaatatacttaccttgggggtcatgtatgtttgtctgcacatgcaagaaatggttcaaaataatgggggacctatgcagaagctacaagtgcatgtggtcaacacaggttatgtagattccaaggatgcaaatatcttagtgacataaatataacaagatataacataaattgcagagagaatagggcttgcaatgaacttttccattgtcagtgtgatcctggttatgctcctccagattgtgagccgccaatatcatcaccaggaggaagtgttaatgatggattttagcttacggtagaaaaaagtgtaccttgtttccaaaacgacgtgctgctcctaaaaacaatggtcttttgatcagtttctacatttcttttttacctttgctcattttaattgctattgttagtcttaaatggaataaaatgaagagattttggagcaaagcgggaacagtaagcagcatatctatctcagaagacagcagcaggaacaacaacgagtcacagagttaaagtagcccaagtgataacttcgaagccatagggtggagaaaggatattaccaagaaactcaccattaactggcctgatctaacaatggttttctctcattttgttatggcttaaagctt

SEQ ID NO: 261865 - DNA, 169 bp, Homo sapiens
tcttttttcttgttttttaaaaatgaatttgtattcccatgcttaatgtctcagtttgagtgtcacatcttcagaaagtacttactaaacactttatctgagactaccctttcattattttcattttcaaatccctattcatttcctttacaaaatttgttattcatcg

SEQ ID NO: 261866 - DNA, 259 bp, Homo sapiens
catgtttcgcttttggaaaaaggatgatgccaggtacggcaaacacgcccgggcgagcgcacacctggggccgcggcgcccgtaatcgcattggcgacgcctcgacaactgtgtctggaggcagccggcgccgccaccttgcgccctcccagcccagggaaacaggctcaggagaaggaaatgctttggattcacttatcctacaaattaactagaaaaatattttggtttcagtccaattttaccccctttcttgtcc

SEQ ID NO: 261867 - DNA, 409 bp, Homo sapiens
taagactcgaaggaaggatactcatgaagctgcttaccccagggcctggtccattttagaaagagttcaataagagtaattatttgggaataataattataacaaaagtagcactaatgcccctgaagttgtcccaggctggattttggtctcattgggaggtggctctggatttgaatgtgggtagtttgaagccattcactagctgagtgactgtggggacaagccacttccctctgtgagcatcagtttccacacctttaaaatggtgtaacattggcccctacagtcccttctgaggatccagggagctggatctttggcatagtctggcctggccgttggtgggcactcaataaatgactggtattgataaccacaataataacaaggagatgccagcaaggtc

SEQ ID NO: 261868 - DNA, 682 bp, Homo sapiens
gtctcagcctcccaaagctctgggattacaggtgtcaaccaccatgcccagctatatcaaactgttaatactggtttttcccaaagagttatatgggtgttggtggacagaggagggtgtgttagaagagagagctttcattttcttacttcatacaatgcagcaatgtttccaattttaaaacaaattagaacataaatatgtatcgtatattatacatacacacacacccatacatataagtaaacaaagaacaataactctggagttgaaaactctggtttcaaatcagctgtaccagttttaccttctctgggctttatcctcctttgtaaaatgagtggattggatcagatgaccttgaaggtcccttctggatctaacattctaactgtgtgaaaggaattaaaaatagatgcccgaggagacagctggccaaaaggtatccagacaataatttcaaggggcttccatacttctaaatgagggcatttgtcaccaatgatcagtgaaattttaaggccctgttttttgtttttgttttaattttgtctttcttctattctgtagtaaaatgtgaaatatgtaactatcttagactaaaataagagtcacaggattttaacttcacagcaggttttaagcagaagattgaattctctaaattcaaatttagacgcct

SEQ ID NO: 261869 - DNA, 461 bp, Homo sapiens
ctcttactacacacaaaacattgttctgagcgcctttcaaatacaaactcctttcatcttaagcaccacccgacagggcaggtactattaccatctccgtttgacagatgaggaacctggcacaggaagcatttaagtggattccccaggatcgccccactgtcaggagcagagtcagaatgggcctcagcatcaggctcccaatcctggcttctaactgctgcgctctgcccttctctctccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctcc

SEQ ID NO: 261870 - DNA, 538 bp, Homo sapiens
gtagccaccatacaggccagggtcatcactgtgctcctccatggcccaggtctgtctgtcctgaagccactgacgggaaggggtggcagcagtgcgggtgtattcccagagagcctctgcagttgtgatgaggtgggtccctgagtgacttggccttccagtctggtcccccttctcgccagtcctgggcaggtcaggccagctaggtttgcttatgcatggcttcaaaggtgaggccttttacaaactctgtttatcactttgctgcactccttgagggtgtacaggattggtgtgtttatgataatccttaaaatcaggacagatgattgccctacactcccctccccccaagtctaggacctgagcctgtctccgtcacatcttgaaaaggcaagagttctgtgtgactccttgtgcagagtgggctgaagcttgggcaggtgtctcacactccaggtgagtgaggtggctcctggcctttgtcttcttttcctatgctgaattaaataaagatttttctgaagtaattcagtca

SEQ ID NO: 261871 - DNA, 306 bp, Homo sapiens
aggataaacattgctattctaaaagagagcaatgggaaggaagaaaggagtaacaggtcctggtaagtccaaaacgcaactgggcaaacattaaattcttaggcctcaaaataatcttcttggaccccatgtcccactttcaagacacactggggtagggtttgggctcctgaaactctgatggccctgcccccatggctttgctgggagaagccagtgcagcaactgtcctgggttgcagtcacatgcctgtggctccaccagtctgaggtctagggtgaccctgctgccatgactccactagac

SEQ ID NO: 261872 - DNA, 449 bp, Homo sapiens
atggaactcagtggccaatttgatgtggaacaggaaaacggaatggagagtccagaatgtggcagatttctggcaagaatggctgggtgggtgagatgcatctgacagatcaggaggcaagagaggagcagactcactgacagtgggtagaggctgagttcagttatagatgtgctggttttgaagtagttatgagacattcagctggacccagccagttgtctgttgaatactttggtctgatgcttaagggagatactagaattagaaatattgtttcaaaaatcagcaagatacaaggggcaattaagcaaacaacagtgaatgatacgacaaaggagactgtactgacagtaaagaactattgacaaagtagaacctttgggagcttcggtatttggggcaggaaaggacagaggacaagaaacctgcaaatacaattaagaaat

SEQ ID NO: 261873 - DNA, 176 bp, Homo sapiens
ggcacaaaaagacaaatactacatgttctcactcatatgcaaaatcctaaaaaggtgatctcatagaaatagtaaatagaacagtggttaccaaagactgaagagggtgggtggaagggagcttggggagtatagtcaaggaacacaaagttacaattaaaaaagaaggatagatg

SEQ ID NO: 261874 - DNA, 532 bp, Homo sapiens
ggcgagaaaagcacaacaaatcacattctagcagataagctaaactggatgtggtttattaaagacatccctaagccacaaaactggattagccgtgtgcacttgtggccgcgtgtacacaaccacaccccgaggcacaggcatggctcttggtttatgagatatccacgcactcaggacagtgacccagattgcaggcccgtgccaggtgagaagcagcgagtgccgccgccgcaccgtcccccttcctgaccactgagtgctgtgttggctccagagctctccctttagcctgggggttcagatgctgaactgggctccccagacagagtgctgcttgttcacagccggttatgctcggccacatacaagtccccatctggtagctggaatgaaagcagctgtaagaggatcccatggaaaaggtatgtgagctcatgtgggtgtggaaggaaagaactggctctgtaggcagagctggtggttttgttgtgaactctagggtttgcagcaggctggccctagccaaaaa

SEQ ID NO: 261875 - DNA, 714 bp, Homo sapiens
tgagctgaaagaatgcacagacctgaggaggcagataagtggctcttgtgcttcaaggttattaggaaccttgatggaggaacaccaaacagtctagagcatgcggctccactggggagaagtcactgaagagttagaggagaacttatttttaagatctgagggaggtgcagttacagtaagaacaatgaaagacttgctgaaagaaagttttaagaaacctttaaatgtcttagtttaaaaaattagcaaataaaatgaaaatgataatgattattgctgggaaaaaaattagttttctgaaaaaagatcccatgacagtgactaaaaacttagagttcgaaatcagaaattagtagacaagatctaagtacaggtccctaccttacaaatattaggtgggtggaagaagaagagaatgagaataattgaacaaataataagagtttatctgaactgaaaaaaaaaaataaaaaggtgtgcctcaaacttaaagggtctttgagtcccaggaaaaagtatcaagatacaaacctaaacagacatttgattttcaggaattaagagacagtagtataggtttccagacaggttgcttcaaaggaatgagactgagattagtattgaacatctaatcaaatctgcaatcctgcaatctctttctctctctccttcatacacatacacatccccccacaggatgtcagtcaagat

SEQ ID NO: 261876 - DNA, 500 bp, Homo sapiens
gagaagaggaaacacaagaagaaactcctggtgcagagccccaattcctacttcatggatgtgaaatgcccaggatgcgataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctggaaagtgctttccaaatcagtatctccaacccaaatctctctcctaaacttcaaacccacttatccaactaccagttggatctcaagttaggtgtctcataggcatctcaaactgaactcaaccatccttccctaatcttctcctccagggtttatctactgaatgacaccatcatcatcatctacctatctgcataagccagaaatttaagactaggttggtcctcttctctctactctccctagtaactaaccaccaaagcctaaatctttctca

SEQ ID NO: 261877 - DNA, 385 bp, Homo sapiens
tgagatcaagtgccaaaggacatctcaaaatacccacagccaaaacttctcagcatagctccctgcatggagaaggagacagctctgcaagtctttgtcctgaaccgtttacggattttccatggtctgcaagaccttggactcacgccgcctgccagctggcagccgctgtccagcctgggaacagagcttgctccggcctgtggcgagtcctcccggggcttatcgtgaatttccccggttttgcatcttcatcctgaaaacctcccgacctttccttaatgaagattttagctgggggaaattgcattagtggctcgtgtttttctgtcaaccttctaaattatgttagttgtaagtaaaaagagtacagtaagtcctttta

SEQ ID NO: 261878 - DNA, 501 bp, Homo sapiens
catgcatcgttctggctggggcacgacaaaagacaccgaaagagtcttatccactcagtcggggtgaagttaaactaataagcaactgctctaagtcttacggaaatcgtctctatgacaaagaaatggaatgtgcagagtctcgctctgtgccccaagctggagtgcagtggtgcaatctcagctcactgcaacatccatccacctcctgggttcaagtgattctcctgcctccgcctcccgagtagctgggattacaggtgcccgccaccacgcccagctaattttctgtatttttggtagagatggggtttcaccatgtcagccaggctggtctcgaacttctgacctcaggagttccaggcctcccaaggtgctgggattacaggcgtaaaccaccgcgcttggtctgcccaatactttcaacattgctctggatcttactgtaaaattcttggaaactgctgtgatactaagataaccagatatttacaactgata

SEQ ID NO: 261879 - DNA, 400 bp, Homo sapiens
tttagttctgtgccttctttggtgaatagaggggtatgacctgaattaataggtagttgagtgtctcaatttggttgtgttgtcttggagtatttttcacgcagaatccggtgatttatctaccatagaggcccacacaggtccatgggaggaggtctcccctgagatttgagctatttcctctccatttcacagacaaacaggtcattctggttgaaagcagggcccttatagagctccatggcacacagggttttaatttgatgagtcatcttttgttgatctttgcttaaatagctttagtccacagttgcatagttgattttcaggctgtagtttctttcctctgtgaaggtttgaggtttgttccttcattacccttttactttttttacttaaa

SEQ ID NO: 261880 - DNA, 544 bp, Homo sapiens
tggtgaaatggggtgaccactgtcatcccacagaaccaggggcttggtgctgctggacagcaaggacccccaaggccaagtcctgggctccttggggacctccctgccaggccctcccatgggatgcagccctggcctcttcacagggccctgccccaccgcccacaaccccctgcagccaggaccctcacctgtctgtgcaccagaactacctgggaagctttataaatgtcaaggcccaggccccacccagaaactctgagtcaggggcctgccctgggctccagatgctgtatgtagccaggacaggtgccccaggcttccccaccactcacgtggtccagcccagcaggtacaccctgcaacgtccctttctagtcctcacccctgcccacttccctgtggctcaaacctggccccaggacaaggcagcccgccccaccttacaggggaggcccagccacacctgtcactgcatctagccactcctgggcccatacttggggcacacggggtgcctgccgtcctctccctctgctccctg

SEQ ID NO: 261881 - DNA, 410 bp, Homo sapiens
taatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaat

SEQ ID NO: 261882 - DNA, 751 bp, Homo sapiens
tggtgggagaagaggggttggagtgaatccatctctattcaaattccagctgggattactctaggagtcttcctggcttgttttgggctcaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttcttgtctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacggaatgaat

SEQ ID NO: 261883 - DNA, 400 bp, Homo sapiens
attcgcggccgcgtcgacataaaattcattgattttgatatttttccacgaagtaattcttttcaatttcatcatgatcattggtcacacagcatttcttaaaagacttcaccggcctggcgcggtggctcacgcctgtaatccttgcactgtgggaggccgaggctggtggatcacgaggtcaggagatcaagaccatcctggttaacactgtgaaaccccgtctctactaataatacaaataattagccaggggtggtggtgggcgcttgtagtaccagctacttgggaggctgaggcaggagaatgccatgaacccaggaggcagagttcgcagtgagccaagatcatgccacagctctccagcctgggcgacagagcgagactctgacaaaaaaaa

SEQ ID NO: 261884 - DNA, 415 bp, Homo sapiens
ttttcgccaaagaaatctaggattcatgaaaccccaaccaacagctggaggatgtgggctctgagtgagcaagttcccttggttctcagtaaccttcatcctgtggagagaaagaagtggagctggggagatgaggaaggaggaagctgagttcattcctcagaagctccagacccagggccaggttcccttttgctaggtctcagggcagttctcctgccaggaactgtactaggaaaggagatacagagctaaaatgcacatttcaagatgtcagaggaacttacattttagtgtgattaatactggaaggtttacatgatttaatattttctgaactgtaggttaactattggaagtacaatcatgaaaatgaaaacattttaataaaaatgatagtattattaagtataaa

SEQ ID NO: 261885 - DNA, 791 bp, Homo sapiens
tctcaaaaaaaaaaaaaaaaaaatcaggttcaagatcactttcattccaacaactatagtcattattgaattttacttaccttcatggaacatatgtatatctcagcatagtcagatataatggaaatttctcttagaaaaataaccgttctttgtaaaattcacctttttagttgtgatagatatctaagatttaattccatcaagtggaaattaagatttttctagtcaggaaaatctgactagatgtgttgaaagtatgggacaaatcaagaaaaacactgacaaaattaaatctttttttttttttttgagacggaatctcgctttgttgcccaggctggagtgcagtggtgtgatctcggctcactgcaacctctgcctcctgggttcaagcgattctcctgcctcagcctcctaagtagctgggattacaggcacccgacaccacacccagctaatttttgtatttttggtagagatggggtttcaccatgttagtcaggctggtctcaaactcctgacctcgtgatcctcccaccttggcctcccaaagtgctgggattacaggcgtgagccaccacacccggccacaaagttaagtcttaactgaagtttttccttttgatggataaactttagaggcatggttctgcttattaaagaaatttgttagggaagccacgctgaagacctccgtgtgacagaagggttcatgaacaaggcttcatctgctcactctttctgcagacgggatcatttctccgttccccacccctggcgtttggctc

SEQ ID NO: 261886 - DNA, 378 bp, Homo sapiens
agaaggctcttggctgagaaagaggaacttttaagtgaaaatagaataatcactgaaaaactccacaaatgcttagaagaggctgcccatactgagatgagcctgaatgagaagatcacttacctgacttccgagaaggagatggcttctcagaaaatgactgaacttaaaaagcagcaggatagtctcttgaaagaaaaatcctcactggaaacgcaaaatggagctttacttgcagagagagagaattccatcaaagccataggagacctcaaaaggcaatgtgatcaagagtctgcaaacagaagtttagttgtgcaagagaatatgaaactcctcggtaatattgatgctctgaagaaggagcttcaagagaga

SEQ ID NO: 261887 - DNA, 374 bp, Homo sapiens
tcatgtctctgaaaacaaggacgatatcttttgttgcttttgtattctcaaggcctaacacgtctaacagaagacggcgaaattagagatgaggaagattaaggagattcaaagtgggagccaatacagaagcaaagatgacatcctctgatttggacagaattgtcctgctacagagaggccagagagtataacataataccaagagttaccatttacttaaagcttactggttcttgggcactgtgtgtgaattgtctcagttaataaggtctgaaataggtcctcttatccccattttacagattgggaaacagacccacagaatttaagcagttaataaaggattgggttcatacttaaatccaggtcta

SEQ ID NO: 261888 - DNA, 815 bp, Homo sapiens
gtatccccaacacagcagcaagaacaaaccaggtacaacattttttaaagttttctgtttagtgtataaaaatgagtaaccactaaaaatgtactcttcattttattactatggtcaaataacttcattatgggtgtaactacaccaacaatgatgatccaagtaaaaatctggggtgcacatactgacattttaatcacctaatgagttttcagtgttgggcgataagtgatgttatcgcccaacacaagcatttgttatgaaaagggaagaacaccacataggacagaacttaaaccaactgcatttttgtagcataaatttaattttctaatctattttgagcatctcattttgtaaataacagcatatcagatgttaattcttgagacatgacaactaaatgcaataggcaattctggtctgatttggtagtaggggaaaagtgctttaaaggatgttactgggtcaattgacaaaactggactatggacagtagattaaataaaagtttcatatcaggccggtcgcagtggctcacacctgtaatcccaacactttgggaggccaaggcaggtggatcatctgaggtcaggggttcgagaccagcctggccaacatggtgagaccccatctctactaaaaataccaaaaaaaaaaaaaaaattagttggacgtggtatgcgcctgtaatcccagccactcaggaagttgaggcaggagaatggcttgaacccaggaggcagaggttgcagtgagccgagatcgcaccactgcactccagcctgggtgacagagcgagactctgtctcaaa

SEQ ID NO: 261889 - DNA, 952 bp, Homo sapiens
ctgaggtggtgcacccacatgcctggcaggttggtgctggctgttggtgggaggcctcagtttcccaccacatggactcctctacagagctgcttaagtgtccttacaacatggcagttggctgctcccgaggaagtgattcaaggagagcaaggcaggaaccatgtcttttatggcctagccttggacatcatttctgcagtcctactggttgccagatgggtcctattcagtgaagaggggactctccaggatgtgactactggggctcactgggcagcatctcagagctgccaccatgctgctgcgtggttggcccatctggaacacttagtcttcagtcacttggtttgattcaagaacaaagagttagaaactcttcaccttttgaatgcaaggaagtaggctgacccctcaaagtgtgccagacaagccattttaagcatagttgggtgagatgcaaagaggaagcctgcatattcgctgcttacgtgaaatgtttggcgcctactcatgctttctatccacagagtctcactgatagtttgtcagccttgcatcccatctgccccatgtgggtcctgtgaagctgctggtcaacctatcccctggctttgggggaatgcaacccatgtctggccaactgtggtgccccatttcccagtctagagttgttggtccaagaggaggctctctcttactctgaaatcatgagctgagggtttactgtgtatgcctgaagctatcagacaatgaagaaagaagagagagaaagagagagatttgagcacctgggtccagctatgactgaagctagcaagacacccatctttgttctctgaaattatgtaagaaagtaaactccctttttggaattttgcttgtttacttttgcttaagttaacttgagctggaatttcatcatcacaattaaaaacatcctaacaactta

SEQ ID NO: 261890 - DNA, 513 bp, Homo sapiens
aggcagaggttgcagtgagcagagatcaggccactgtactccatgatctcactccagagtaagaccctgtctcagaaaacaaaataatcccacaggaagtggatagcagtgtctatgaaaactgtggccactaattgatcactgcggacggtgagagatgggtatgtaacattctttacactcttctctctacttttgagtatgtttgaaatttttcataataaaaagttaaggccaggtgtagaggctcatgcttgtaatcctagcactttgggaagcagaggtgggaagacagcttgagcccaggtgttggagaccagcctgggcaatatagcgagacatccgtctccacaaaacatagaaaatttagccaggcatggtagtgtgctcctgtagtcccagctactcgaggacgcccaggagagaggatcgcttgagcttgcggggtggaggctgcagttccactgcactccaccctgggcaacaaagcgataccttgtctccaaaaaaaaa

SEQ ID NO: 261891 - DNA, 454 bp, Homo sapiens
gggactatcgaagattgcttaatcactcaacaagattttaaaacgtgattgaagaccgcctacctgtgagggcagcgccgaccaggcttttcttgcccgctagtccacgtaatgcggtcgctaagaagcccgcagcagggttttcgcgtgaccttcatagggcctggccaggccagctgaggggcgcgccgggctgcgcttccatcgaggaacctccgcacatgcaatcacggttgtctcgtcttctggcaaccctggatctccacaaactgatcttcagggtgcttctctcttcagcagttttgcctcaagggcatggcgcctcagctagtttttggctgtaaacaaaccgcggccaccgccaggctaccgggttaccagtacctgttcttcggagtttcttaggcataaactataagaactacaaataaagattttctgcttccttatttca

SEQ ID NO: 261892 - DNA, 311 bp, Homo sapiens
gctggagcggtgcaatgccatgatcttggctcaatgcaacctccgcctcccaggttcaagcaattctgctgcctcagcctcctgagtagctgggattatagacgcgcgccaccacacccagctaatttttttttttgcaacgacattaagtgaggacttgctgtacagacttaaaacagaagccaaagacagagctctgaaggatcacagaaaacagaagataaattagcaaagccttccaagcaaaagtgctttaaagggtattaaacgcattagacccatgacatttgtgaggaataatctaaagatct

SEQ ID NO: 261893 - DNA, 609 bp, Homo sapiens
gtaccaaaagaattggaagcgggacctcagagacatttgtacacgttatgttcacagcaacactattcacaattgctaaaactggaagcaactcaagtctccattaacagacgaatggatctgttatctgttatgaatggcccttgggaggccaaggcaggcggatcacctgaggtcaggagttccagaccagcctggccaaccaatatggcaaaaccccgtctctgctaaaaacacaaaaatcaggccaggcgtggtggctcatgcctgtaatcccagcactttgggaggccaaggcaggtgatcacctgaggtcgggagtttgagaccagcctgaccaacatggagaaaccccatctctactaaaaatacaaaaaatcagccgggcatggtggtgcatggctgtaatcctagctactcgggaggctgaggcaggagaatcgcttgaacccggtgggcggaggttgcagtgagccgagatcatgacattgcactccagcctgggcaacaagagtgaaattccatctcaaaaaaaaaaaggccaggcgtggtggctcacacctgtaatcccagcaatttgggaggctgaggcaggcggatcacaaggtc

SEQ ID NO: 261894 - DNA, 543 bp, Homo sapiens
taaactgggatgtttgattaacctccacattgtacttctggcttcccccattattttgtctagtagtgttcacacatgtagtgaacagagtctcattttaccatttgggtaaatctgaaaaaccctgtccaaacagtgttaataacatctccttttaaggacagcatgaaggattcttactgttaaaacaaagtgagttgaagcatgagcagctggagattgctcactacttctgtcctcaagtggtattactcagagtaggcctgccaaatgtagaaattaactagactggcagttgttggggtaagtgagaaataaaggctaggtagttatgaaagatgtgctggacaacgctgagcagtcatgccatagagctgtcctctgtatttggttgtagcatggcactcttgttacagaagttttatcatttattatacagtctacaactatttattaattttatcctttgtcagctctttttacattttgtaatgtaatgagcactcttatgaaccaataaactaaaaagtgtgtgtttattga

SEQ ID NO: 261895 - DNA, 593 bp, Homo sapiens
gcgattctcaaatcacaatgtgcaaacttcacgtaaaataattaagtattttttatcaattacattttcacgtatgagacaaatattttaaagtaaaaattaacctgtaatatttatttttacatttttcattaactaagatattatcactggtgttagtcctctgtattattcaggattctccagacaaatggaacccataggatagatagatagatagatagatagatagatagatagatagacagacagatagaaagtgatatgttatgaaggactggctcacacaactgtggaggctaagaaattcaatgatctgctgtcagccagctggaggctcaggaaagccctggtataggtccagtgtaagcctgaaggcctgataaccaagggagccaatggtgtaagtcccagtctgaattagaagaccataaacccaagagtgccaacatctgagggcaagagaagatgaatgttgcagctcaaaaatggagtggacttgccctttctccacctctttcttttatttgggccctcaacagattggatgatgcccactcacattggtgaaggtgatattcttctttgaccag

SEQ ID NO: 261896 - DNA, 679 bp, Homo sapiens
ccctgttgagtgtgattatcgaggccagtgctccgctgcctctcacgtaccatttcgctgctggtcactcctcattagtgcctttcctaagggtaatcagaggacacagaaggaaattaaattgaaacctgagagtattcccaccatctattttccttatctgtagttgggcctcctgaatttggttctagaacactccaaggacttgagttatctcaaggagattgatgaaattcctgctatgaagttagctttgattacaaaacaatgtgtcacaaagtacaacatgttctaattggagttttggagctagatggagctggagttgaatcctagctccatcctggcctactgagcaagtctctcgattgccaagcatcagtttctccatctgtcaaatgggcacagtaatactaaacccacagggctgtatgagaagtaacaaaacaacactaggataggccgtagcctggtgtctggcacatggcagacctccaggaaacagtagtgtccgtctttcctcattggtacttttttgaggggtgaagaaagagtggggaagagagaagaggaagtacatcaataaatgataagaactcactcacacctattaaaaggtttataccaaagtttttcgcactatgggctgctacccattagagagttgtaaccagaattg

SEQ ID NO: 261897 - DNA, 387 bp, Homo sapiens
atcagagaagacgttgaggtggagaatgtgagacccacatgcacacaagccggcatgctcttccctgcctcctctttcttttgtgacctcttatggaatgctgtgggaaagcactcaagtcctgaggttccattggctacggaaacgaagaaatttgaactaactcttgctaagaaactgtaattaggacatggaccctgacataattatctttgtgaatttcattgtgtttttttttttattttttctaagtgaaattgcttcagaaaattggagagccatcttacattccatgtggagaatttattagctatgaaaataattcatgaagttatgggtagaaacatgttgttaaccttgaaggaaaattaaaatcagagtaataaa

SEQ ID NO: 261898 - DNA, 410 bp, Homo sapiens
cctaaaaaatccacacacaagcactaaatgccttaaatattgctcaattcagaaatgaatcttaattaagtcaacatctatattcttcctattttactacatgacttccaagtaagatgccacaagcgtcactggtataaattgctccggaaaacctgaaaacttacagaaaatcacaatcacattatatttaacaggtgttataaagactgcccagtttgtccaaataaactagttttaactgctgaggactgagtatcagttctcagtttcagcacaatgcttttactcaattacctagattaaatcatgcttactcaatggtctagattggtacttgcgtgtattttgtttccaagtacttgcattcactttagggcaagaaaaaacggtattacatttgatcatga

SEQ ID NO: 261899 - DNA, 468 bp, Homo sapiens
aacaccccttcctctccttcttgtccctacactgaccagcttctcaccccttccttctcacatgctcagggagaaacccatgggcagagtgacacacgccttggtcatcactgtgtcccggtgcctagaggagggcctgctcagagcagcctcacaagaaatgtgcttttgacttaaagaccacagtgagaggagagactctctcagtcacacccccggactcttgtccccacagagccccaggtcccctacccctttgtccatgccactgtgtgggtcaggagagctaggctcgagtcctgacactgagcagacacaaagcttgggcaagtcacttccccctcccaggactcagttgtcctccccgtaaaaggagaggcagtaacatccacttccttcatagggctcccatgagaggaagacgttagaagctagaacaatgcaattcaattcagtctgacaatctga

SEQ ID NO: 261900 - DNA, 2451 bp, Homo sapiens
  misc_feature (76)..(76): n is a, c, g, or t
gggagggcggcagtgagggcgcggcggcgggcggcttggggctggattccggctccctcgctcgctcgctccctcncgagccccctcccacccaggcccaccccacccagcacccctggcgcagggactgctggaacctggctgtgcgcgctgtcgctttaagacagactctgccggcgccgtccggagccttagaaaccggccccggatccgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 261901 - DNA, 243 bp, Homo sapiens
gggcaggcggcccctcgacgaggacaccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtgtgcacgagccgcccgggactcgcag

SEQ ID NO: 261902 - DNA, 2279 bp, Homo sapiens
gggcaggcggcccctcgacgaggacaccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261903 - DNA, 1934 bp, Homo sapiens
ggcacgaggcgggccccatgtcatggggtggcggcggcgccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261904 - DNA, 2118 bp, Homo sapiens
gccgatcaagggatccggcccacgtgcgcggccgaagcccggagcagcccggctctggcccccgccccggctcctgcgcgtctccctccgcgctgcctttttttgtccgagctggagcttttttccagcagcgaactgggcccgcgggtggccggcgcgggcagtggggcagcgaatccgctgcccagcgcagccggccgggttccggaggggctccgagctccccggtgtgggcgcctcttctgcgttcatttcttaatacacagctgaatgtttctctccactttcttaagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261905 - DNA, 1246 bp, Homo sapiens
  misc_feature (76)..(76): n is a, c, g, or t
gggagggcggcagtgagggcgcggcggcgggcggcttggggctggattccggctccctcgctcgctcgctccctcncgagccccctcccacccaggcccaccccacccagcacccctggcgcagggactgctggaacctggctgtgcgcgctgtcgctttaagacagactctgccggcgccgtccggagccttagaaaccggccccggatccgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcatccctgctcaagcatagcccagctctggcctcggccggtccccacgtgtctcacgcctgcgttaccaggtatccccggtcttgtcgggggctgcg

SEQ ID NO: 261906 - DNA, 160 bp, Homo sapiens
ctcccggcccgcagcggccctgacccttctcccgtcccctcccccaggtctggttcaagaaccggcgagccaagtggcgtaagcgcgagcgtaaccagcagctggacctgtgcaagggtggctacgtgccgcagttcagcggcctagtgcagccctacga

SEQ ID NO: 261907 - DNA, 2502 bp, Homo sapiens
  misc_feature (76)..(76): n is a, c, g, or t
gggagggcggcagtgagggcgcggcggcgggcggcttggggctggattccggctccctcgctcgctcgctccctcncgagccccctcccacccaggcccaccccacccagcacccctggcgcagggactgctggaacctggctgtgcgcgctgtcgctttaagacagactctgccggcgccgtccggagccttagaaaccggccccggatccgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261908 - DNA, 2007 bp, Homo sapiens
acaaaaaaaaaaaaacggacaaaaacttaggctaggtacgaggcctggtgttaattcggccgaggctggcgcgcgctgacacccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261909 - DNA, 1904 bp, Homo sapiens
ggcggttcggtggagccgggacggggtgcaacggggcgtaagcccaggtgacccgctccccgtcctgcctactgcagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261910 - DNA, 919 bp, Homo sapiens
gcggccgcccccggggagcccggcgggcgccggcgcgccccctcccccaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcaaaaaaa

SEQ ID NO: 261911 - DNA, 1141 bp, Homo sapiens
atctgacctgaagtgtcagtggtgctgaggttcacaataagctcctgtgcaatgaggacatttaaaagaaatcaaaatgttgataacgttattgctgggtctttgatatgttgccttagggtggaagaagtatgtgtaattaaaggaactaagctttctgcccaccttgaagttcaagattgtttcgtatggcatccaaaatgagggagactttctttttctgaattaaaaattttcatttattttccttttctgtaacaactcttctctcaaggtccccctgcagtagcaacttatacggtttcttatacggtagtgtggcagccttttggggaaggaggcacatgcagaggagctcacaacttttgctttaaaaagccaagcactacaggatgtaacgtaaatgaaagatgcagtaacctctggagtcaccgtgacttccctgtcaagctgccagcagttccctaggttggaaaatgggcatggtcataacctaaccacttctgaataggtttcagaatgaccatgttcaaaaagagatgtgtggctggatgcggtggctcatgcctgtaatcccagcactttgggatgctgaggtgggaggatcacttgaacccaggagtttgagaccagcctgggcaacatagtgagaccccgtgtctaaaaaaaaaaataacttagctgggtgtggtgttgtgtggctgtagtcccagttccttgggaggctgaggtgggaggatcacatgagcctgggaggtggaggctgcagtgagccctgatatcatgtcactgcactccagcctgtgcaacagaacaagaccctgtctaaaaaaaaaaaagatgtgcaaaaatattttagtcaaaggtaatgtctgactatgatataaataatagcagtatagtaaaggatgagcatccccaatgcagaaatctgaaatgcttcaaaatcccaaacgttttgcatgcctgcatgatgttcagaggccatgctctacagaaatgctcactggagattttggattttggctcttcagattagggatgcttaactgggcataaggacatattccaaaataaaaaaaaatgtaaatcagaaacacttctggtcctatttcaaataagggatactcaacctgtataa

SEQ ID NO: 261912 - DNA, 424 bp, Homo sapiens
tgtggcaggaagcagacaagcaattttgagggcctaaagaataccagagagattgggaacagaaatacagagttgaggactgagagttatttaggagcatgagacaatgactagaactgactcatactagctaaaaatcaatcatattttttaaaaattttgtgagctggttggttgttaaacacaacagttactaaaagtgaaactgggctgaagcgagtggatcatgaggtcaggcgtttgagaccagcctggccaacatagtgaaatcccgtctctttttgtattttgtaaaaatacaaaaaattaggtgggtgtggtggtggctgcctgtaatcccagctacttgggaggctgaggtgggagaattgcttgaacctgggagatggaggttgcggtgagctgagatcgcatcactgcactc

SEQ ID NO: 261913 - DNA, 794 bp, Homo sapiens
aatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgtaccaaataccctgtgactccctaaacgtaag

SEQ ID NO: 261914 - DNA, 337 bp, Homo sapiens
ccctgccctgccctctatcagtaggcataaggctggttccaggcaacaggcaggagggtattggtggtaaggggaagtatttcaatctgattgacatgcgtgcccagctctgcctgctcagtaccttgggaagttcagaggagggagtcccttagccccttcctggctgagttgagggggctgggagggcatggagacccttttgctcagctgcctcctgtatgacaacatgggcagggcagcagcagcaacaagggggcaacacttccattacaggcgtgcccaaggcccggcctcccactgaggcccggaccccttagtgtcactgtagaaaatt

SEQ ID NO: 261915 - DNA, 273 bp, Homo sapiens
tgcacaatttgttggactgcatctctatctcgagttctccatgacactcaggtgtggtgttgcccaaataaaatagtggtctctgcctctggtggcttgacctgggacacgtgcacatgaggtacatgggaatgggtccacctgggctgggagaatgtggctggtggtccccgaagaaaggccaaagagcagcccccgaggaagcgtctacttcagctccctgggagaacgagagctttgtctgttgttttagagacattttagaatgcattt

SEQ ID NO: 261916 - DNA, 255 bp, Homo sapiens
ttttttttttttttttttttgccattaaaaaaatattggcaaccctgtgagagtctctgaagtttcattttgaagcttcccttgcccatgaaatccaaagtctgggacccactggcctgagatcacacgtggttctctggcagcagtcaggctgttggttggcatggactgtgcctgagctggaaacccccaagggtgcttctgagcaaggaaagcgagatggctagggagggaggcagctttgcgttactgttg

SEQ ID NO: 261917 - DNA, 780 bp, Homo sapiens
accttgcctcatttcacacacaaaaattaactcaaaatcgaagacctagacataagacctaaaactataaatctcttaaaacagaagggaaaagcttcatgacactggatttggcaatgatttcttgaataagacaccaaaggcacaggaaacaaaaagaaaaaataaactgggcttcatgaaaaatgttaaaatgtgtgcattaaaagacacacagcagagtgaatgggaggaaatattttcaaatcacgtatctgaaatgggattaatatccagaaactcctaaaacttgacaaaaaataatccaattcaaaactggttaaaatactcaaatagacaattcttcaaaagtgcaaatgctcaataaacacagaaatgcaaatccaaactatgatgtcaccttcacacctattagaatggctatcaaaaaatactaacaaaaaacaaaaaaaaaatgttggtaaggatgtggaaaccctgaacccttgcgcaccgccggcaagaacgtaaaaaggtgtagccgctgtggaaaacagtgttgtggctcctcaaacacttaaagacagaaatgccgtgtgacctggcaatcccacttccgggtatacacccaaaagaactgaaaacaggctcagatacttatcacccatgttcttcacagcattattcacgatggctaaaacatggaagcaacccaagagcccatggaggaaggaatgggtaagcaaaagcttatctccacatacagagggttattcagccttaaaaggcaaggaagttcca

SEQ ID NO: 261918 - DNA, 529 bp, Homo sapiens
tcagcacgacccggcgccagagacaattcagttttctggaggtcaaagaacttgacggataacatcatggcacaatgtagcaaaaacaagcctcctttgctgccatcactgtatcctctccatcactgcctgaggaccagggagtggaatgaagtttgtgaatgtgggagaagggtcggaagtcctcctttagcagctgggttaaacctaagcaagctaagcagatgaagcagaggatgttccttagcttgatataatgttactttccttagattgatacaatgttaggagccccgcgaaataagcaaggaaagaatgatgttagatttcagcaatgtaaacataatattgatgctcaatatatgctaagtaataggccttcattattgatttataaccaggccactagttggtaaatatgtatctactgatgaccaagaacaaggctggtatcagcaaattacaagaaggaacaaatttcccaatgaaggctgagaggtggtaatataacctccattcaaaagaagaa

SEQ ID NO: 261919 - DNA, 476 bp, Homo sapiens
acttgcaaactaaggggaacgagcttccctctgaatgtttatgaaggagagaccactgtgaggatagacagtgaagtgcaactacagcccgcaaatgaaaatgaataaaattaatccagcccctcaaggcagtcatctgtcttagagctattggaatcctggatcattgtgggaaatgaaaaatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctccttctggcttcaggactccatctccagccttatgatctaaaaataatccccaaaccaaaaaattagatattatttcctcaaaattaggtgttttaatcaaaacatcttaacataaatacattattatcacccaataaaaaa

SEQ ID NO: 261920 - DNA, 631 bp, Homo sapiens
acttgcaaactaaggggaacgagcttccctctgaatgtttatgaaggagagaccactgtgaggatagacagtgaagtgcaactacagcccgcaaatgaaaatgaataaaattaatccagcccctcaaggcagtcatctgtcttagagctattggaatcctggatcattgtgggaaatgaaaagaactggtttttagcaaggagaccaagaaactctactccctaggggctagcaatgagagaaaggaagccttgagtctttgagcacagggtgacagtttgggtcctatgtgagatgatcaaatccacagcaacagaggaaaggacaaaaggaaaagatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctccttctggcttcaggactccatctccagccttatgatctaaaaataatccccaaaccaaaaaattagatattatttcctcaaaattaggtgttttaatcaaaacatcttaacataaatacattattatcacccaataaaaaa

SEQ ID NO: 261921 - DNA, 785 bp, Homo sapiens
acttgcaaactaaggggaacgagcttccctctgaatgtttatgaaggagagaccactgtgaggatagacagtgaagtgcaactacagcccgcaaatgaaaatgaataaaattaatccagcccctcaaggcagtcatctgtcttagagctattggaatcctggatcattgtgggaaatgaaaagaactggtttttagcaaggagaccaagaaactctactccctaggggctagcaatgagagaaaggaagccttgagtctttgagcacagggtgacagtttgggtcctatgtgagatgatcaaatccacagcaacagaggaaaggacaaaaggaaaagatacttcgatggaatcagcagccattgatccaatgccaactccaagactggaacgtcgcaatgatagttccaaggcggaaatttgacgtaattcttttcgacacagttttacaggtgtgacaccatgaagtcgtcccacatttcccacaacctgaatttgggatgacagtcgactgagattttgtaaactgattatcatctgtttctgttttattctcattacctaacatatgcccactggggggtgctaaagaactatgaattggaggtctggatgcccattttaattcttctgaaagcatgcctccttctggcttcaggactccatctccagccttatgatctaaaaataatccccaaaccaaaaaattagatattatttcctcaaaattaggtgttttaatcaaaacatcttaacataaatacattattatcacccaataaaaaa

SEQ ID NO: 261922 - DNA, 486 bp, Homo sapiens
acttgcaaactaaggggaacgagcttccctctgaatgtttatgaaggagagaccactgtgaggatagacagtgaagtgcaactacagcccgcaaatgaaaatgaataaaattaatccagcccctcaaggcagtcatctgtcttagagctattggaatcctggatcattgtgggaaatgaaaaatacttcgatggaatcagcagccattgatccaatgccaactccaagactggaacgtcgcaatgatagttccaaggcggaaatttgacgtaattcttttcgacacagttttacaggcatcttgcatgtgaataactcacaactttaattcatggaacaaattgagaaatagtcttttgggggtttggtactccctggaaacataagagtgctttgggcacctctggtgcctttccatgcctgccttctctgctgttcttgctactagtgaattctaaatcatggccaagtgatgccagcactgga

SEQ ID NO: 261923 - DNA, 337 bp, Homo sapiens
agccttgagtctttgagcacagggtgacagtttgggtcctatgtgagatgatcaaatccacagcaacagaggaaaggacaaaaggaaaaggtctgtagcagcactacatcagaaaaaatggattccgcaaggaagtgggtgactctgagtaagcatccatgtcaggatggttttgctacagcccccaaccaaacattaattagtttaagaaactcaacttcggtttacaagtgttttggaaaagtaacaaagaacaacctaaataacaaaataattcctcaggtcattacaatggatgtttcctataactgaaaaatatggttaaaaagtacaaact

SEQ ID NO: 261924 - DNA, 474 bp, Homo sapiens
ggcgagcccttgtgagagaggtctaaagatagaagacatgaaagagattcagagctgcagaagatgctctcctgttgttctgcaagggcagactgccatatgtgagaggctctatggagaggccacacaggaagcaaggacctgcatgcagcctccaggagctgagagcggtccctggccaaaagctggcaaggaattggagacctcagtcctactgccataaggacatgcatcctgccaacaaccagggatcttggaatgagaacataagcctcagatgagatggcagtcccaggtgacaccttgatttcagcctggtgagaccctgaacagagaacccatctgcaccatacatgaacaccagcctacagaggctctgagataacaaatgggtgttgttttaagccactgcatttatgatcatttattatgcagcagtagaaagctaacaaatgctgtgagaaaaagccaaat

SEQ ID NO: 261925 - DNA, 435 bp, Homo sapiens
ttcataattagtactttttctttgaatgtgtgagtggtagatgcaattggaacccttttgcaactcttcttggttggaaagttatctaaagttgctaatcagaccctctgctaatgtaaattctatatactgagacactgctaaacacccattaattttaactttctcattaaaaaggatgacatagaaacccttctttgtagtcaatatagatgtattttctcaaagtgaatcattaaacttaagggctttgtcatgtgaggcctctgaaaattgtacaatattagaaacatcaatgtctgtgtttaataaacttactggtagctttactgtgttgaatgtctccacctaattttgtttgtttaaaaccttgcttttggaaatttagcccttcaacttttctttaacaaaatcttggaatgaacttctgattta

SEQ ID NO: 261926 - DNA, 363 bp, Homo sapiens
cccctttttcttgtttgtgaaactgtaacagacctagtcccagcattaacagagtccctgctggggagcaggaatggaacatatcttgtccacacattcctctgttgcttaggccccagagctgcaagcccactttgttataaaaatgcagttgtgcctaacaactgtctgcttcttggtgattggctttatgattgcagccagctaagaaatggtgttgtcattccagaagtctcggtggtacacaacgctgaagtcggcagctaacaagggctatgagagatgagaatttcactctgaggatcctgtggggaggaggcatctgcagcagggactggagggaaccttggtgttaaaaaaaaa

SEQ ID NO: 261927 - DNA, 388 bp, Homo sapiens
gtcactgagatttttgggtttatctgttatagcagctagtattgccttaataattctacaaaataagtacagttattagccttcttttgaagattaatatagcagagaaaatagttttaggtggaaagatattaagctgcctgtattacttttaggtagagggacttataaatataggtctgaagctcaggatgaggccagtgtgataatcaccttgtgagtcatcagtgtacaggtgattgttgaagtcatggaagtgaaagtgatcccttgaggagacaaagcagggaataaaggaagtggactcattatagaattttagtacaagcagtatttcaaaagaggataccatgttggagaccaagaaaaaaagtcagcgaggttaaaa

SEQ ID NO: 261928 - DNA, 374 bp, Homo sapiens
ctcctgcccttggaaaacaagactccaggttcttcagctcttggaatctggaacttgcaccagcagcctcgtgggggctctgaggcctttggtctcagactggaggctgcactgtttgcttggctggttctgagtctgttaaatttggactgagcctcagtactggcttctctggttctccagcttgcagacagccccttgtaggactttgcctctgtaattgcgtgacccagttccctctaataaatcccctttcatatatatcttattgcctctgtccctctggagaaaccctgactaatacagacacttatgttaactccataacttggctattgtgagtaatgctgcaataaacatgggatacagatatc

SEQ ID NO: 261929 - DNA, 445 bp, Homo sapiens
gcttattcaatattttggttgttttggattttcactgtttatgctaccttcagtgtatattttttgaacatctcacagttttccatggttcctataactgaagacttcttgtttcagtgaacaaatgcccaaaagatattcaggaagctctaatcagaggaaatacatatagtcaacaaacactgggcagaaatttcagtcccctcatctcctaaggcaaatttagacatttctgaattatcacctcataaatcaataaaatgggtgcagaaatcaatggaattgctagcaaatcattggcatgagggttgtgagaaaacattaataaaactctgaagattggtacagttttctggaggtttatccatacacaataaagtcataaaacgattctatcatttaacctaggaacacaactttttgaaatttatccaaagaaagagct

SEQ ID NO: 261930 - DNA, 537 bp, Homo sapiens
gatactattaggagaaatacctaatgtagatgacgggcggatgggtgcaacaaacctgcacattctgcacgtgtatcccagaacttagagtataatttgaaaaagaaaaaggaatgaatgaagatgagtgacaagtaacaatgtcaacagattttattctttttggtgacaaagtaaatgtacccatactccctaagacccactgtttgatcaggaggaaggcaaaaagcattctaatctttcatcacaatgcccttcagaaacatcagcgtgtgtgcatgcatatattgttatcttttgaaactaataaaaatcagtcactgaggaaacataaaacaaccaccaaaggtagagctgttctcagtctgcaatgctcaccatgagcagagacgtacggtgatgtacaaaaacttaccaggcagaacccacagaccatataatcttcacaaaagctagaaaaaccagttttggacaatgtgacattttacagaacacattcaagttggtactgtcatgaggggaaacccccataaacca

SEQ ID NO: 261931 - DNA, 369 bp, Homo sapiens
gaggaatcccctgcccctgcccctctgcccccagacctgtgtggataagggaggggctgaacagaggggaggaagacgagcaggcggtggagagcgaacctgacggcattcggcctaggctgtgtgtctctgctgaggctggtaggaggtaggtgcctagaaccctatgtcctgcttcccactgaggtccaccacctgccctaggatccatggtctgcaatagggctggggaggcagcactctcagtttggccaggtggctttgttctttggggcacagatgctacaacggccaagtgctggaccagatggtccatttggagccagttctccctccctcctcgcctcccaatctcctggcccagtttgt

SEQ ID NO: 261932 - DNA, 1563 bp, Homo sapiens
gtgcaatggggcgatctcagctcctggcaacctctgcctcctgggttcaagcgattctcgtgcttcagcttcctgagtagctggggttacagacacccaccaccatgcccagctaatttttatatttttagtagagatggggtttcaccgtcaccatgttggccagcctggtctcaaactcctgacctcaggtgatccacctgccttggcctcccaaagtgctgggattacaggcatgagccaccgcacctggccccatttaatttatataataaaacaagtgcaggctttacctgattttattctcaccttctgttttcttcttctgcattatctgtcaccatgggttggctcctccccactttctcttttttattcttttctctctttttgccacactaaattgtaatgtgtttgaacaactctgacttaatattacctctaacaaaaagctggaaactgcacaaatattctttgtaggctctaaaagtaggttggctgaagtatgatacctgaactaattattcatttgtatgcttgttttataagtttgacttccatttcatgatttttttggtagctttatgttatttctgttttcagcaatgggtactttgacatctttctgtctctgaattgaattttcattttgcaacggaagagaagacaacatatttattccataatgaaagagctaatgaagtagaataactattaaattgagatgttttagcaaaaaaacaaaaacacaaaccccaaacgggttgttttgttttatttttttctaaaacatttctaacaattcccagtaggaatgggtggggccagccttcctcatttacaatccagctgcagtgagtcaagatcctagcttattctcccaattgtgtaataaatgcagaaaaatgatgtgacggtcactattctcaaatccattgcattgtattccacaaaggatatcctggcggaaggtggaaatatgggagggtaccatgatgtaaagaattgcctggaaatttccttgagtcatgcattttgtaaaaccttacattactgctatgagttaataagagacaggttaaaccactcccctcaggatagtaagactggttaaaaacactgctctcagcccacacagttatagctacagcctaggttaaatgattcctcatcctggtgtttttattctcatgtttaattacttctttaaagattaagattatatatagaaaaaataattgtggtatcagagaatacaggtagaatttttcatatatcaggactatgtgatgatacttaagcaatagtgtacatacagtaatatatgtttaatatcgagtatggataatgaaggacttttctttttcaccttgtttataatgacattttatccagggtttgaatcaaataaattcatgttaactgtactattttattgaaatgttctagtcttattattggataattagaaataaacattttaaagtctttatgaataaataaggatgttttcctatgtatacaactgtactattttcattagtaataaacatcactttcaag

SEQ ID NO: 261933 - DNA, 306 bp, Homo sapiens
acggggagggaaaaagtgtaatcttggtcaattctatcatgcaaccagatcaaataacatttcaagtgcagcctgccaagcgccagcgcctgccggagtacaatgagcgctcaactgctctggactgaaaaaccatctttcactggtcccagggatctttataaaatagtttaaacactactaaattacagagttagaaaaaaaaaatacaagctcaactctgctgcccccacactattgtgaagctgctgttaagcatctaaaaatctgccttgtgtaatttactaggcaatgtaaatattcaga

SEQ ID NO: 261934 - DNA, 486 bp, Homo sapiens
attcatttagcttgagttcatttaagaaatctgatttgttttaaattcttggtgtataacataaaacactgatggaggggttcaaatctgaaattttcctaggttaagtcttcaatcctttagtgagcttccttttatggaaaacttggttgtgtgttctgagctaaaaagtaccaagtcataaatgaatatgatagaatcatgtggtggcaaaatcaaagcaaagttacaattatcctctattgaccccagcctactcagcagtgcaaaatgctgagaaagaataaataagttgtctacccttagaacttactacctggctggagaaagagaaattagttcatcaggtacctgttatgggtaaagcattttgttaagtatggtggggtacagataaagataggagaagctccctgatctcaaaaatcttactgcctaattgagaatgatataagcatatgtattaaaagataaccaataaaggtc

SEQ ID NO: 261935 - DNA, 551 bp, Homo sapiens
gcactgtgagcaggtcataatagtggtgggagggttttccctttctgaagccagaatggatgggctgcctgggtcagcgggagtggggaagaggaggtattgggaagctccaaaatgattactgtaaagatcaggggaactggcaagaggggagactagcagtttatttcctggtagcttgtcttctccatccgtggacttgctagcctgcctagtgccttcataagtgggagtgggtggacgtgttgggggaacgtcgggggaacgtcgggggaacatcaggggaacaaaactggagaaagatgcagggggaaggagagtaggagaaaagggaggaagaagagagagagagataatatgatttgctttaaaaacaattgcctttgtttaatactcagtaaaagttcagagttcttattctaagttgagaattctatattctgacagtaatattcaagaaacacttctctaggctaactgaaactatacatctacctaatagcaaaaagcatcccaggttactaaagtctgattcacattttaaaaaaaaa

SEQ ID NO: 261936 - DNA, 278 bp, Homo sapiens
ctaggctggaggactgcttgaggtcaggagttagagactagcctggacagcacagtgagaccctgactctactaaaaaaaaaaaaggtttagtttttgatgttatattttgagatgcctactggcccctgagtgaagaagctgagtaagaagtgaccaccgaggtagaaagaaaacccaaagagtcctgaaagcgatgtgaacaaaggctactcaggaagtgggagtgatcaattctgtcaaaggcttatagggtatagcaagggctgaaaattgatc

SEQ ID NO: 261937 - DNA, 569 bp, Homo sapiens
atcacgaggtcaggtgttaaagaccagcctggccaagatggtgaaaccccatctctactaaaaatacaaaaattagccgggcgtggtggtgggcgcctgtaatcccagctactcaggaggctgaggcaggagaatcacttgaggccgggaggcggaggttgcagtgagccgataacgcaccactgcactacagcctgggtggcagagcgacactccgtctcaaaaaaaagaaaagtaaccttttataaatatggggctgaaaacgttatttttaaattttggaaaaagttctactagcttgaagattacttagatttattttttcttggcttatttagatatttggcctatttttaaaactataaataaataattggattttaatttgatagagaatcagaaaaacagagactttatataatttttgttacatttgaattcattttataaatatatgttgtaaaaattcttccagtgcaatattttttggaaaatattgttctagtcgttgtttgtataggtttatttctaattatattaaaagtaaaattagaaaaatatgtaatatt

SEQ ID NO: 261938 - DNA, 401 bp, Homo sapiens
caaagatgtacatcactgtatactgcaaaaggcatgcagtctaatgttggataatctagaaaaagttctctggctaaagccttttccatatccagatccaaatgagtttgatctccctgtgatacaggggttggaggcagaaagagaggaggctgggaaaacaaaaacaagaacaaaaccaagccaaacaaaaaatcaatgactggctctgactttagatagatctggtttgaatctcactccaatatataataacaggtgtagccccaactactagcagaggcaagagaatagagctatgccacttcttccatcagtaagggagcactcaatgtaaactccctaggaaagagctgctaacaaaagtctttgtgtttcaattaaaccaaggaaagtgaaaa

SEQ ID NO: 261939 - DNA, 878 bp, Homo sapiens
atatcaaaccaatggccttctccactaagccagcaactaaaggtattcagaaaacaagttaatcaaggtgggcagaactttttgaactgtgaggaaatgttcctaagtttagatttattacctgtcatttagggcaaaaatctaatgtcttttttatttcttaatcttgtagaactctgtatttcatagtaatgagtacttagggatcattgctctattagcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaattagtgcattagaacaagatgctctgtggttcagaggggtggaatg

SEQ ID NO: 261940 - DNA, 432 bp, Homo sapiens
gggttcaagcgattctcacacctcagcctccccagtagctgcgattacagacacgcaccaccacacccagttaatcttttatatttttagtagaggtaaggttttgccatattggccaggctggtctggaactcctgacctcaaaagatctgcctgcttcccaaagtattgggattacaggcgtgagcgaccgcacctagccaatttttattttaaaacgatgagaggcgtccatggcagagcagtggtctcaaatcctggctgtgttcgagtggtaccaaccccttctgtgccacttttcttgcccagcagagagttcagctatggaagtacccgaatgacctcttcaccctaaggtggtgctggggcatgtgcctcaaaggcagtgctgtcagaggttcctgggcatctttattacttatagttttcttt

SEQ ID NO: 261941 - DNA, 381 bp, Homo sapiens
ccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctccca

SEQ ID NO: 261942 - DNA, 391 bp, Homo sapiens
ctccccagccatgatcctgtgtagtctgtggaactgtaagcaattaaatctctttataaattatccagtctcaggtatttctttatagcaattcaagaatggaccaatacggttgtgtataaaagtattggctggctgtggtggctcatgcctgtaatcttaacaccctgtgaggccactcgctttatgtcaggcgttcgagaccagcctggccaagatggtgaaacccagtctctgcacaaaacttagctgggcgtggtgccacatgcttgtaatcccagctactcaggaggctgaggaggatcacttgaacccaggaggcagaggttataacgagctaagatcacaccactgcactccagcctgggcaagagtgagactccatctcaaa

SEQ ID NO: 261943 - DNA, 253 bp, Homo sapiens
ttcagagcttcacatgtattaataaatacttataataattcaatgaataggtactattaatacctcattgttacagatgtggaaactgaagcatagcggttaagaaatatgtccacaatcaagcagctagggtcttttggaagccatatgctatattagaaatcttgtgcaccagaataaaaaatctggaaacctgaaatccattttcttcagaatttgcagatgcacaaataacatttctttaccattgtga

SEQ ID NO: 261944 - DNA, 337 bp, Homo sapiens
gcattcagggagccatgttgatacaccagaagaaatctgccaggactaaagaccgacccaataattcccgaggtaccttcaggaaagtcaatttatttttgagtcaaaggaatctcaaattatcctaaatggcattgcttccaccagagttctgttcttaatttaataagctgctacaagttccaagccaatgttccttcttagaaatatgctatgctatgggatgtaaatctttttaagtgcatttcattgtaccaattttttcattttgaaaaagcccattggtttattattaagtggtctatttaatagtgccaataaattctaaaactggaga

SEQ ID NO: 261945 - DNA, 292 bp, Homo sapiens
agaacaaatgagcttattgtatgattatcgaatttgtagatgatccaggctcttaacttctttctcctcttcctgcttgttaacttacactgctttttaaaatctccactagagaggatacattaaaatcagacagtttgtcttggttttagtttcgtgaattggctgatagggaaaagatgttaaagctcttgggcagtaaggaaaagagtaagtatctggattttatgtatttaagacacatgcatgcatatgttcattgcagcactatgcacaatcacaaagacatgga

SEQ ID NO: 261946 - DNA, 451 bp, Homo sapiens
atctcagatgaatcaggttttccctaggcgccagctggatgctggggctcagcttagcctagtgggctcttgctctggtaaggctgtggcaaggggaatgggggtgcttgtgcccttgcagaaacgcctctgtataaacctggcgcatggcccctcttctgcatcttctccctgtggtcagaagaccctgctttgcaagcatacatctgctgctagaaggtactatgtaccaaggggcttctctggtatttaaatgctgatacaggaggcaagagcaaggcttagctcaaaggaatgaatatttttgtttttcaacaatgaaatctcatttttcctcaagtctatgaataacactatgagtaactactatgagtaacatgtgctctttgcaaaacaatcaaggaatacataaaagtataaagaaagaaagtaaacctcacttgataaccca

SEQ ID NO: 261947 - DNA, 935 bp, Homo sapiens
ttgcattactgatttattcactaccttagcagcatgtagtatacagacattctgctcttcctcttcctctctaacacacacacacacacacacacacacatatccctgtacagactcacgcaggcatgaggggtagggatgaaactataagctagaggcttacttgctgcatattccgttgctgccagtctattctaacgtgtaattcatggagaagactacagttaagtactaagaatcttctaaatgtaatttcatggattgcaattgaaatgtaaaagatatccgacaatgccattaaatgattcggaagcactaggaccctagaaaaattcaaggagaaaaatgtaaaccaatttacaaagctattgccctccctgcatttccaggcacaaacaatttatttcaaggtgccttataactgctaggtcttggaagtcaaagagaaatctatcaattcagctttgaggaacagggctgtggcaagcacaggtaccaaaatattatccaccttgtagagtagtcataattttctgttcttcaataaagggatgaagcacgcactgtgattcttaagacacatcttagtgtataagaatccagatctgccgtaggcatgctatgactcctaatacatacaatcactagaacaaaagtctgtgatggcccagtaaacttccccacatgccctatgatcaagatgttccttgtatgtgtttgatgacctttggtattaccactgcctgatctgggtacttccttgtaatttgactttaaaaaaaatgacaccaattgcaaaatttgcatccagttgacaagacatttaaggtgtttatcaggatcatgccctggccccagcttcccaataccagctgttgaaaagattctctctcatctggagagaactggagtgcacagttcacccacgtggctcc

SEQ ID NO: 261948 - DNA, 386 bp, Homo sapiens
gctttgttctgcccccgtttacattgttttaaaggagaaaaatggcctagaggatgtgtaaaattgtgggagggtcaggggagaaaagagaaagaaagaaacaaaataagcacagaattacaaaaaaatcagaaaagagaaaatgctaccctgcaactatgtttggcctgaaaaattacaactttcatcgtcatcattctaaatatttttttgttaaatcaaagtttatggtaaaaaatacctgaaaaattccaaaatattcatttaaaccacataaataatgcttcaaaatgatcataagaatgttttttgtttagtaaatatttaatatttcaatttgcatcttgactagtagatattaaagtatcaacttttacatcccactt

SEQ ID NO: 261949 - DNA, 474 bp, Homo sapiens
agtttactgggatctaaaggaactccccaaacctttatgatttaacaggagacaagataagggtaatcaccccagcacctacacctatttacattaagtaaatttactgaggctccagaagaaggtcttcaggactcagaccttagtcatagattaaaagaagttaatcacttatgtctttagattaatgcacacttacacacagacatatagcttgaaggtatatacactctgaaaaacttcgtaattttgagttgttctggcaataatttccaggccttctccctgtaactggttacagaaataaaaactctcttcctccccagttcatctgcatctcattattgggctgcgagacatagcagcctgaccctcagtttggtttgagaacatcaccatgttgccaaggctaatcccagcactttaggacattgaggcaggaggactgattgagcccagaagctcaagaccagc

SEQ ID NO: 261950 - DNA, 891 bp, Homo sapiens
aacaggtgtataccggccaagtttggaagaagccagaaataccttgagaatgtcttaggacaagattagaaggaaagataattcattggaaggagtccaggagcctgggccactcaagtctgtactcactgaaggttaccatgaaatcatctgcatggaagcccttgtttgtcaatatctatttgtcaaatattatcttgagagagaaggttccacatgaacaacaacaaaaaaagttgttccatttatgtttctctaaatgccaaatgaagtattttaaataagcattttataaaaagttatggtaaagctgtagctgctgaaagcctgctttaggaaaatagtgatacatcttatcaactcaagcagtaaacaggaacttccagtgctgcatgatggaaggtcaccatctagaggcccaattgtattaggatgtttcactacaagctccaatgactccagaggctaggaaggcagcctgtgtaagaagcagcagccagccccaaggagaggagggaacagcaagactttggccctgcagactttgcctcagtaaatgcattcaaaattccagttacaaacaaaacaaactaaacacagtgccttcaaactgagcaatctgccaaatcaagctttgatcctgggcctctgctcactgtcagaatatgaatggaaagttgaatgtgataagtaaagtgataactccttgggagataagctcaaagagattccaaacaatggaggcttttacaatttcttgtacaaaatctttgcttcttgggagtaactttacaattgaaaatttggtttggttgtggtaggtggtaaaggaagctgtgatattttcagaaaattaggaagaaataaagtcaccagaagatatcattgact

SEQ ID NO: 261951 - DNA, 329 bp, Homo sapiens
cgtctatctcctcagcactcccttgccctgaaccccatcactggggctcagttgctggttcattcattctttgtaactccggtcatcattttccgggtgcctttcaagtaaactttccttagtgaaacccttcttccagctgaatgtttcttcctttcgtgagccctctggtctctatgctatttcctgtattctgccctctgctctccatacatgtgtattttgtgttctgtcctttattagattgtaagctccatgagggcagagtttgggtctgattacccatcctttcccccttttggttacagtctcccagtttttctttggga

SEQ ID NO: 261952 - DNA, 455 bp, Homo sapiens
tacgtgctttaaagcctatcgagattctcaaatgtattttagtatgagaaacatcctttttaactagataaaagtttaaaggtataatctctgcttctgaaaattatgacaataactcctaatctgggtgctgttctctgaatgagtcaccaaaatcatctatggtggaattgttggatctcacaaggttctttcacacagtttttctaaattctttggctattagtttcaacaacttaggctatcgagccatatcctgtatttgttattttcattgaaagttgtttacctattttgcttttggttttaagcctagattgatggattaaattttatacacattaagaaatttttaaaatattctatacatttctaaatcaagcatagccattttttcagaaagtgtgataaagttaaatatggagtagaaagcttatagtgcaagccaaacactt

SEQ ID NO: 261953 - DNA, 495 bp, Homo sapiens
tttagtagagatggggtttcaccggttagccaggatggtctcgatctcctgacctcgtgatccgcccgcctcggcctcccaaagtgctgggattacaggcgtgagccaccgcgcccggccatgcatacaattttgaggatcatgagcatagagtaaaatgagaagaaattccacatagttcacgttggttttaaaatctgttttggagagcaaacccatttaagaacatggtaaatgcatttctagaagcagcatgcacgcacacttttgcagataattttggaggtttctcagactcttcaagcctttccctggacccgggattaaaaacacttgacataaaagataagtagaaaggaaacctgtgaaggaggctgagcaggaatcacagagagcgaagtggaatgccaggagaattggaaggctggggattaaggaggagaggttttcagaatgaggacatagcagtgcctggctcactaatgggcccagtga

SEQ ID NO: 261954 - DNA, 829 bp, Homo sapiens
tgctacagtcctctattaagcaatgtgccacagcagggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgtta

SEQ ID NO: 261955 - DNA, 713 bp, Homo sapiens
tgctacagtcctctattaagcaatgtgccacagcagggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcgtgtgaaatggaactacggtgaaatggaacctgggacctctagaacgctac

SEQ ID NO: 261956 - DNA, 700 bp, Homo sapiens
aaaagagtacagtgcacattgcccctcagtgtctgtgtgagtgtcagagggaaattttaagtctaacctgagagctctaggcctcactggcttgtacataaagatggcacacatcaggagtcacagcctacatttcagaacagctgactctctccaggcctcagctccccacaaaatccctcaagcacttctggaagtcaacaagggtttcttactgtacctcaacgttctacttctctccgacatccaaggacttgtcactggttcaagcttgggactggctccgcttttcctgaggatgagcccaatcccaggaggctcctcagtctctgctcagtgaacgactgttgggtaggtcttgccaagtcttcagaggcagctctgcaccccagagatggacacgaccagactcctgcaccattgcacacacaaatcgcatgttcccaacactgacgggctttaagttcttggacaaaaagactttgctttctatttattctgtactgtctttcctagggttcttgaacaatgtttgcaaaatagtgagcacttaatactgttaccacatgtattgtttcagaagtaaagtgggtgccaggcagtgcacttcaatttcctcaaatctgaaatgagaaagttaaaataaggaccaaattatatgataaatatagaagcacattaaagagtattcattccatat

SEQ ID NO: 261957 - DNA, 554 bp, Homo sapiens
attctttagttactttttatagttacttcagttaatttaaactgttttcaaccagcaggattgcttgagcccaggagttcaggactggcctggacaatataatgagacctcaactctataaaaaactaaaacattagacaggcatgatgttgtatgcctatagttgcagcttctcaggaaattgaggcagtaggcttccttgagcctgcagtgagctgtgattgtgccactgccctccagcctaggcaacagagtgggaccttgtctcaaataataataattctctctttctatacacgcatttagtgaaataactcccttttcacagctaatagcctgcatattttgatatgttgtattttaatttttattcagttttatgtattttaaaaatttcctttaggattttctcttagatcaatgtatttagaactgtttaattcccaagtggtggggagtggggaggctttatttttgtataataccgatttccactttggtttgactttgctcagaaaatacactgtgtattatttcagttcttttaaaaaaaa

SEQ ID NO: 261958 - DNA, 423 bp, Homo sapiens
atagaatacaataaatgaatctgcctggtacctttaaaaaaaaaatcaaaggtctgccggccctgccacccgaacccagtgagaggccctgcaagggatccccaagtccttaaggggctggaaaagtagcccaggagactggacagccaggcaggaggtcccggtagctgtgctccagctggtgctcctgcgaggaggcggctttcgaggtcccagtctccttctagctgtttctgaagcgagttgtcctgcctcctcctctcacctgtgctggcccctccctgccctctcagtgtccctggcctatcagagagtaggtggggctggggatccgcctccacagagggttctgggaccctggtcactgtctttttgtatttgcgatgctaatttgttcaacataaacatttaaagtctactgta

SEQ ID NO: 261959 - DNA, 549 bp, Homo sapiens
agctgtggaagctgctggtgcggtccctgcacgtgtggccgccggggctgagggcctaccgcgaggtgtcctctatgttgctaggaggtcagcgctcacagctcaggtcccttccacccagtggtggaggcagtaggggtgtggggagccttctgctgcagccctgtttcccgccctgcgacccaccccgagtcccctctgtgtcccacctcatgtccaccctgtgtccagccttgtgtccagtctgtgtcccgccctgtgtctgccctttgtttaccctgtgtccatcccgtgcccgcctgtgtccaccctcttcctcctcacttggagctgcccccacccacctgccgtcgcagcccctttagaggtcaccagccctgaccctttcgtcgcccagggccctgcggtgctctgcctgtggccctgctcccactgccttggagggaggctgctcacagcgcttcatgccgggcactgagtggtgcagagtcttcgagaaacctttactttttaaaatttttttattaaaaataaaactattaactgaaa

SEQ ID NO: 261960 - DNA, 516 bp, Homo sapiens
ggaatcctttgggacctaattccttgacccacacgttgatgacgcaactagctacagaagggcggcctcccttttgttcccagagaagatgttggatcttggcacagttctgcatgccattctgaaactaactttctcttctctttcaaaatttaaatcacagtggttacaactcagaaaaaaaatacagcttttatataaattaatacagtgatatttgcagggtagcaaatgttttgttgaataatagaagcacaggcctcttatcaaaatatacagtaggttctctcagtttatatgcagcattctttttccaaatcttctattgaaggtttaggaagtcaattttttaaacccattatttttaacagttttttcatacagctttctaggtcataattttgacttctctttgccaatagtgattgatagggatgtattttgcaagtttctacaatgaaacccaagacaagctgttaattatgacctgtttttcctcatttcaaaaaaaaaaaa

SEQ ID NO: 261961 - DNA, 341 bp, Homo sapiens
gatggcactggaaaaccaagaatagctaataatagctaacatttattgagtacttatttactgtataccaggtgctattctaagtgctttacattatattaactcctataatcttcatagcccagtgagagaaggacagttcttacagataaggaaaagtaggcacagagaagcgaagtcacccatggaaagtcagagatggaactaggaaatggctgagctgggaccagaatctggagagcccagtcctaaaatctccattcttaactccatactctcctcctccctattgacataatttagaaaatgaaaatatattcgaagcccacatttagaaccaa

SEQ ID NO: 261962 - DNA, 275 bp, Homo sapiens
gtgaggcataatgatgtttctgtcaaggacgggctgcatataggatggtggtgtcatatgatgataatggagctgaaaaattcttactgcctccttgcagtcacagccatgatagtgtcatagtgcaacacattactcatgtgtttgtggtgatgctggtgtaagcaaacctgtgctaccagtcgtgtaaaattctagcacacacggttatgtatagttcataacacttgatcattataataaatgattatgtcactggtcatttactgtatgta

SEQ ID NO: 261963 - DNA, 459 bp, Homo sapiens
cttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagggggatgcatcaggacgataatttcaagagttcaatggtgaatttccttggcttccactgagctacctgttaacttcaacaagcacactggcctggagactacatgatggtgtctcagtaatggatttacaactgcaaacatctcaagcagcagtgccacatccctgctacctccctgcttgtgcgtgtgtccctacattatccaaaataggggtgggctaatgacgattgcaggctaactccagcctaccacttgcttctataaataaagtcttattgtacacaaacatagccatttatttaagca

SEQ ID NO: 261964 - DNA, 289 bp, Homo sapiens
atcatgttgaatttttcccaatggtaatcttatgatggctgcagctacctgttaacttcaacaagcacactggcctggagactacatgatggtgtctcagtaatggatttacaactgcaaacatctcaagcagcagtgccacatccctgctacctccctgcttgtgcgtgtgtccctacattatccaaaataggggtgggctaatgacgattgcaggctaactccagcctaccacttgcttctataaataaagtcttattgtacacaaacatagccatttatttaagca

SEQ ID NO: 261965 - DNA, 474 bp, Homo sapiens
catcattcgagctgagcatgggtttccattcagcccagaagtttcaactgcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatggcagacaggacagagttttgaaaagtacaaagctgggtgggtgcaatggctcatgcctataatcctagcactttgggaggctgaggtgggaggatcacttgaggccaggagtttatgaccagcctgggcaatatatcgagactccatctctattttttaaaaaataaaataaaataaatgttaaaaagaaaagta

SEQ ID NO: 261966 - DNA, 516 bp, Homo sapiens
cttttttcatctgcataccccagctcaccaagcattccataccctccccccaacatttagcacatagaatattctttaatggcaaagtagctgatgatatttcaagtctgaactactcagataactaagtattaaatgtaataatgagtaattaacttgtatccacccaaagtttgcccagagtgctttctaggaaacccccctcaatatacataagtagatacaaatctccttttaaggtctacagttcccactgtaagagggggaagaaaaatggaattgtattgtcttactggtccagtaggagctaacatgtctgacaagtggcctgtattgtcccaccttcagtccctcctgtttttaatgaaagttataaactagtgtctctctcgaccctcattgaaaactaacacctatgagtcagtctcaggaagtctgttgaatttgtttccccagtattcttgcttaaagaaaagttccctaggctgaagtaagccagagatttaaattaaaaaa

SEQ ID NO: 261967 - DNA, 676 bp, Homo sapiens
gcacgtgtcccattgtcatctcctctaaggagccttctgcattccggctacgctccgaggtgcccgccttttctcacatggctgcagggcatcagccccattgaccagtatcacttttgtccacttagagacccaagaaatgcagaactacacacagacaacttaggtcacacacatgatgtccaggacaaaagctttcctgattttaatcatctgggttttgtttaggtgccatagtaacagtctcctcttgtctcattctgctctgactcctgatcagtggcctgagaaggagggagaagcagagaaaacatgagtaatgaatgataacgaggatgtataacctcacggaagtgttccagggaaaacttgtcgaccatctgctaataattatcaagtaccccagtcagtggcagccattctcctttccattgtgtgaacttaggtctgtgagctcccccttctaatttcagtcagtctggccctagacacttagggccaagagatctcatctgctgagtcctccctgaacttaaaagaccctgaagtgagacatgctaaattgcagaactgcagggcagcagttcaaattggatcttgtttttacaactgaagaaccacatggcaggcaccgtggggccagggactgacaaagtcgtggaacaatattaacccg

SEQ ID NO: 261968 - DNA, 100 bp, Homo sapiens
gtggtgtgtcacattcagaaggcctttaatgcctgtttgtcaaattcttggctaattaacaactgctgtgtgaggtaagccatggaggaggccgtgtgaa

SEQ ID NO: 261969 - DNA, 390 bp, Homo sapiens
taacataaagatgtacatctatatgttatatatctacatctgtctctccttttttataaggcctaaaaacaaatgctttattacttgcaaaccacaacatcaaaacaattttatatgttaaaaataagacaacagggaggctgaggtgggtggatcacgaggtcaagagatcaagatgatcctggccaacatggtgaaaccccgtctctgctaaaaatacaaaaattagctgggcgtggtggtgtgtgcctgtagacccagctactcgggaggctgaggcaggagaatcgcttgaacccaggaggtgaagattgcagtgagccgagatcgtgccactgcagtccagcctggcaacagcgagactccttctcaaaaaaaaaaaaaaaaaaa

SEQ ID NO: 261970 - DNA, 349 bp, Homo sapiens
cactccacccctttcctttcctaccctatcccactcctcgaggaatcatccctggctcccacctcagtttcccgcctccaaggcagcatggcgggcaagaagttgaggccactgtccctgggtgttcctacccccacaccctcaccccaagacagcctgttactgcggcgccaacagccacggtcgcctacatctgataagacttatctgctgccccagggcaggccggagctggcgtaagccccagtggggcgctaagtgagtgtgcccctgcctcccgccagcactggcctggcctgcaggcttagcctgggtcatcaaggtatcccacaggctctagttcaaatcc

SEQ ID NO: 261971 - DNA, 1574 bp, Homo sapiens
aaagccaacacaacccagtcagaaaatttaggtcagagtggcactcaccccagctgatggcaaacagccttgaatcagagcctgagcagccttctctggctaactgcagagttcgctctctaggcttcagtttcaccactgtaattatgagcgagaagcctatagttaattacaatgcatgaatgggagatattcctggacttatttgcattcattacttgctggtagtttctctgttgaggtctccatccttgtttttacagagcttttggcagtgtttctgcagttggtgtgtgaatttttatgatctgttgcatgttattcatgcaatttcctgccctgtaatggtatcagttttccagacgcagaggaatacagactaaaacccaggagcctgtattagcataaaatgtcccagttctgtcagtttgattaatttgtctctttgtctccactctatatgataagtgctattaatggttgcagcacttcatatgtcaaagtctttcttcctaatgacttgaaaatgcggtttatttcccccctttttgtattatttttctcatttagcattccactcaagtatagatttatgccatgctctttcattatcttactggttgcagcactggagtgattacatatggtgtagagtatgcgtaaagatgtgatcccaggggcagcagctgctgatgcaagctgaaaatagatccagcgtacgctcagcacttttcccagaggccttttatttattagtaacagtcttcgtacaggacagcttggatcctcatttagcaagatgactttttgcctttctgaacactgcagtgactttgctctatttactgacactgctgtgtaatttttttcaaccgccttgtatctcagcaatgacttaacctaacataaattgtaatataatctcgatatataatgaactcaagaagcgataggctccatttgaagtaatagagcttgacagatctaaggtttaaattaaataatcctatttgtaagacagcatttgtacatggtacactgctttaaaatgaatttctattcttctccagtggttcttacaccgtttttagtattctccctttcaaaaggacttttcttcagaaagaaatggattgcaaagccagcagctctttcataaggaaagaataagatgaaatgtttttttacccagttcaatcactgaactggaaccagcatcattaatgatttgaaatgggtagttattaatccaagctggcaaatccaatagctcagacttttctatcagcacagtacatctgtgatacaaatataatagcagaatttaggattaagataatagctaaccttctgtacatggctttaggttcaaatatatattttttcataaatttgaaaagtcccaataatgaatatatgtattcatttttcaaataaatccaagaagggctcttattttgtattctttttgagaggtgtactttcagtaggataaggagaaagttcattgtatatcctagcagatagcatctagataataatttctcactgcatgataaaatttgccaaattgc

SEQ ID NO: 261972 - DNA, 405 bp, Homo sapiens
gtgatggcgcctgggccccctgaagcctcctccccgcacttgtccaggttttaactgaagaggagccagagagccgttgacatctgagttgatcatctccagggacccctctatcccagagccctggatccccccagatgccagaccaaggctgcgggaacagcagtatgccaggtgcagggcctgtgcaggcagcctgggagcttgttccccaggagtgtaagaaaggctggcgggtctgccccactccaggccacaaagagtgtactttctttggggcatttttggtaagctttcagatgatgtattcattaatattttatctgcagtgtgaccttaagcaacttgtctaactgctttaggcctgttgtgggacgaagccccagaggagggcttggtttcgtt

SEQ ID NO: 261973 - DNA, 200 bp, Homo sapiens
acctatattcattttaaaagaaaaagttaaacaaaaattttttaaatccttattttttaaaaatacctggcttattcctactactcccttatgagatgtctataaagagtatacagagcctaacaacatagtaaagtagatataagtagttataagcctgactcattggtttgtttgcagaaaaaaaaaataattctaaa

SEQ ID NO: 261974 - DNA, 405 bp, Homo sapiens
agttttaaaattatatttgtttttaaattagcactgttttatgtttggactgtatatatttaaatatattatttagttaggattatatctccatttcaagggtttgggaattatatgccctttaccaggaaaatggaataatacctgtaatcccagcactttgggaagctaaggcaggcggatcatgaggtcaggagatcgagaccatcctggctaacatggtgaaaccccatctctactaaaaatacaaaaaattagctgggcgtggtggtgggtgcctgtagtcccagctactcaggaggctgaggcaggagaatggcgtgaacctgggaggcagagctggcagtgagccgagatacgcaccactgcactccagcatgggtgacagagtgagactctctctta

SEQ ID NO: 261975 - DNA, 484 bp, Homo sapiens
gactgacaactcacttacaacccagctgaagaactggatgctctaacagtggtatatacagaaactctagcaatgtgtaacacaggatataataacatttctgagaaatatgcatttaaagtccagttttaatctgcaggcaactgacactcctgctgtacccctggcactgggctggaggttccatctctagctgttgggagctatgccttaatcccaattactggcctaatgcaagggttctagcagggctgagagggagaagagtggggtaaaagggcatccaaagagttcaaaaacaaggcacctagaggtgtgagtgcctgcagtgtgcagacaccctggggctatggtcagctggcatggcctctcttcaacctttctttccctgtatacttctcttcctactgtgatttccatcaaattctcctccaccctgtgcttgccctaaaataagcatatttccattttaagggtttactgc

SEQ ID NO: 261976 - DNA, 498 bp, Homo sapiens
agtgtggggattccttaaagagctaaaagtaaatttaccatttgatccagcaatcccatactgggtatccacctacaggaaaagaagtcattattcaaaaaagatatttgcacacacatgtttatagcagcacaattcacaactgcaaaaatatggaaccagcccaaatgctcatcaatcattgagtggatttttaaaaatttggtatatattttaaatgcttaaaaatttggtgtgtgtatatacacacacacacacacacacacacatatatatatatatatacacacacacacacacacaccaaattttatatataataccaaatttggtatatatatatacacacacacacaccaaatgtatactgtataccaagtgtacactgcttgagtgatggacgcaccaaagtctcggaaatcaccactaaagaatttatccatgtaaccaaacagcacctcttccctaaaaacctattgaaataaaaaattaaaatta

SEQ ID NO: 261977 - DNA, 375 bp, Homo sapiens
tttagtgcatattgttcctcttagtatacagtcagcccgctgtatacacaggtttcacatcctgtgaatattgtattttctatctgcattggggtgaaaaaaaaaaatctgtatgagtggacccacgtagttcaaatctgtgctgtttaagggtcaacagtactcagtcgtgtatttgatattgtaaggaatttgtgaaatgagtagaaagatctctttttttaaagaaataaccatctagattgcaaaaactgttttattgattttatagtggataatttatagcaatacaagttcatgttgaaaaatgaaaaaatataattttatattatttaaaatatgttattttatattaaatgcaaatttaaattgtta

SEQ ID NO: 261978 - DNA, 545 bp, Homo sapiens
agatgtggtgctgtgggttaggaattgtaggttctttaatgttttctgaaaatggagagccaaggctgaaattactctgtaatgcctttttgttgctgggttgtttctgtgaatgtgacactgggctgaattgaaccacagtgaaatctggaatttatttgatttgcacataaatgggattatgtcaaccatactgctttgtaattccttttgtcttgaaaatatgtgatggagcttctatttgagtcaaccaatatgaattacatgattcttttcagtggatgcataaagtctcttgtatgaatacctcgtatctttttgaactagtctcatgttggtggacattttggttgtttctaattgtgatgaacatcttgtgtatacttgcatatttatgtaactacctcattgggatagattcttggatataaattttctgcatgaaatggtatgtacgttttacattttattacataacaccagcaaaaagtcatgctgatttatattcctctcactgtatattaaagtcccatatccacaaaatc

SEQ ID NO: 261979 - DNA, 690 bp, Homo sapiens
ataagactggagtttatgagcatgatctatactacatagatctatactatacagagttgaacatcccatgccccacccaaacagggatcgatctatctatctatctatctatctatctatctatctatctatctagcatagatcatgctcataaactccaatcttatacaccaagtgcctaatgaatatttctccctcaatgtacaaatgaaaactttagtaccgatctctgataacccaaaacttgttacaccacagtagtcgcacctgggtgtcaatgccatcattccagatttaaagtgacccttaattcctctctttctctaatatcctaaaggaaatctaacagaaattcctgtcatgactatcttttaaatatatccataagccaatcacatgccaccacctctgctgctaacacttagtgccactgccgtcatatttcacctcaatactgtcaataacctaagtgggtttctctgtatctacccttatcacggtcaccattaggctattcttatcaaagcagccagaacgatcatttttagatataaggaaggtcctatgattctcctgaaatctgctcaaaatcttctagtatctgcccatgttactcagagtaaaatccaaagtttttcaaaggcccaaaattaatataaacacctgtgtataagcaaatgagggtttctt

SEQ ID NO: 261980 - DNA, 341 bp, Homo sapiens
ctgcctcagcctccctagtagctgggattacaggtgtgcaccaccatgcccagtgaatttttgtatttttagtagaggtggggtttcaccaccttggccaggctggtctcgaattcctgacctcaggtgatccccatgcctcgacctcccaaagtgctgggattacaggcgtgagccaccgcacccagcctagaatttttttaaccctttatacacacacacacacacacacacacacacacttttcaaaatcaaatataccaagagtcttttattgaaaaggagcagccctcttctgtacctctcttatttcccagagggaactctttaactcttttagc

SEQ ID NO: 261981 - DNA, 598 bp, Homo sapiens
cacaaagcctgtttggtggtctcttcgcacagacacttgagaaagggttcagtaaaaaaagaaaaaacagctgggctatctcgtgccaacaaacgaaagggaaccacaggagcagagcaaatgtgggcaatgttttgaagacaacagactataaagagaaggaagcagagctatagagcatagttagacgcaactgaagattgcttactgccctagtctgttcacactgctctaataggataccattggcttgtaaaacaacagacgcttatctctcacagtcccgcaggctaggaagtccaagattagggtggctgcagatttggtgtctggtgaaggctcacttcctggttcatacatggccactttttgctgtgttctcacatggttgagggggcaagggaatctctctgggctctcttttgtaaaggcactaattccattcatgaaggcatcaccctaattacctccctaaagccacacctccaagtaccatcaaattaggattagatttcaacatatgaattttgagggatgcaaacagcctgttgctcttagttttgcaacagggaagccaaaagatgctaaaagaggctga

SEQ ID NO: 261982 - DNA, 539 bp, Homo sapiens
atgattttcttattattcagattaaactttttttggcagaaaactacagaagtgatgttgtatattgtcaccctagggtatctaattaggagacgcattaggtcagtttgttcttttattggttatgctaaatttgatcttttgattaaagtgaggtccatcagatttccccactatcaaatatacctttcttcattaaaattaataagtaattgaaggagaaataatttcagattgtgttactatcctgttcttcaacagtctttcatctgtgcttttggcatctattactaattattatctcaatcaattattactatggtggttgcaaatggtgatttttgaattctattattccttcttaatttattagttagaattattttgcaaaacagagcttttgcttgtccactccacttaaaatattatttatttatcattgttaaacatataaacatgaccacacacacatatataatatatatacacattttatatttgtatggaatcatgaattaaaaaaattcattttgttatta

SEQ ID NO: 261983 - DNA, 265 bp, Homo sapiens
gttaggttcatgctggaatattccctccaaagcaaacgataaattgctgcatcttatatctcatacctcaaaaaagaagtgcctggtaggcctctttgggttctgaaggcaactcatgccacacttaagactgcagttccaggccaggcgtggtggctcacgcctgtaatcccagcactttgggaggccgaggcgggcggatcacgaggtcaggagattgagaccatcctggctaacacggtgaaaccccatctctactaaaaaa

SEQ ID NO: 261984 - DNA, 410 bp, Homo sapiens
ggatcacagatccctggaaattttttgtaggatggtttaacgttcattcattaaaaacattaaatatttatttttctttattgatacaaaatagatgtacatatttttgcacattaagtatttttatgctgtaggcacaggagaaacagcagtgaacaaaatagaagaggaaaaagtccctgtttacaattaggggggtggtagggagcctatattctattctggtagaggaaaacagatgataaactattaataataatatgtaatgtagtaggtagagaagtgctttgaagaaaataaagcatagtaaggaggatagagtagggagtgaagttggagagtagaatgctgttttgtgtcagattaagaaagacttctcctacaattatggtctggcattcatatacagt

SEQ ID NO: 261985 - DNA, 303 bp, Homo sapiens
agcctggggagtttgaggcttcagtgagccgtgatgacaccgtactatactccactccagcctgggtgacagtgagaccctgcctcaaaaaacaaacaaacaaacaaacaaaacaaaattaatctttttgctgatgtcatgtcagcagtgtgtgttgaaggctgtaaagcagccatttgttcagtttatttttccattgaacaagtatttatcaaaaacatactttgtggcagtcactatgctaggagctatgaatacagaaggaaaagtaaatgctcttggatactacactccagttgtgat

SEQ ID NO: 261986 - DNA, 790 bp, Homo sapiens
aagagtacactcaagatcacccttacttctgacaccaaatgcaagttttggtgtttcccaaaagaatcctcaggtttgataattcactggaaagattcacagaacttactaaaatttttatattcctgattatatttattacaagaaaatgttacattaaaaatcagccaagggaaaaacaaatagggcagagtctaagaggattccaaatgcgaagtttccattgtcctcaggaatacattattctaccagcatcgatgtgtaacaaaagcatggagtatggccaacctgaaaggctcacccaaactttagtgtctacagttttcactaggcattatgacataggcatgattaattggttgaacttaacctccagcctgtctcctcctcaggtcaggctgatatcacatagctcaaagttccctccctaaactatgattggtctttctagtgtcattataccccaccctaagactgactagtgtagaaggccctgccctgagacatctcattagcataagctatcaggtgtaatttaagggagcagcatagataagaaaacctgtgtaactcataaaattccaactgtttagatgttgcctcccagaaactgaaaacaaaggtcagatatctctttggatgaagcaaattctttactacaaagtatcctttatcaggttgaataacttttttactattcctagattaccagtagtttttatcacaaattgttggattttctcaaatgttcttctatatctattaaaataatcatattgtttactctgtt

SEQ ID NO: 261987 - DNA, 554 bp, Homo sapiens
gggaatttgtccatttttcttcttataaaaaccatctacatctttacaccacaatcttgcaaagtttaagatataagtatgattatatctatttaatgtaagtatgatttttgtgtgcttattttaattttctatttttaaaaagaacttaataaaggaaagaaaaaacattaaaatgatagattgtaaaatcatggaaggcatacaattttagctatgagttgtagctgaggcttgaacttgtaggtataaataggctattaatctctttctttgtaataatatatgagtgaagaataaatatgaatcttattggatatagtttagtaaacatgtttggttagtcaattagctgctaaatcagacattttcatttggtttactacactcatgacaataaacacaaattaacaagtatttcatatcctatattattttgtccccaaggagacttttgaatattccttcagataatattcacagagaatcacagctatttggcattctatggatccagagggacatatgcttgctggcacattgaggaccattgc

SEQ ID NO: 261988 - DNA, 521 bp, Homo sapiens
agaggacagagaaacattgaactgcaccatgagagtacatcagcagatctggacatataaatgaaatatcttaggtactttaacggagagattgtaaggaagagacagacaggaaaagagacttgaacgctctaccaaaaaaaaaaaaattcttagaactgatcaacaaatttggtaaagttgcaggatacaaaatcaacacaaaaagatcagtagcatttctatacacaaacaacaaactagctgaaaaagaaattaagaaggcagtgtcatttacaatagctataagaaattaataaaatacctaggaataaatttaaccaaggaagtgaaagacctcttcagataaagctgcaaaacactgatgaaagaaattgaagagggatacatacaaatggaaaaacatttcatgctcatggattggaataattattatagttaaaatgaccgtactacccaaagcaacctgcagattcagtggagtccctattaaaataccaatgacattctgcacagaaata

SEQ ID NO: 261989 - DNA, 347 bp, Homo sapiens
gcctatggggaggggcttggggagtggtatctaaatggtgcagtttcttttggaggtagtgaaagagttctaaaaaatgactgggaggccaggtgcatggctcaggcctgtaatcccagcacttttgaaggctgaggcaggaggattgctcgagccaaggagatcaagatcagcctaggcaacatagcgagaccccatctctataaaaaaaattaattaaaggaaaaagatgatcagggcagtaaatacacaagtctgtgattatactaaaaccattgaaatgtaaacttttaatgggtaaattgcatagtatttggattatatctgaataaagctgtttttagaaa

SEQ ID NO: 261990 - DNA, 496 bp, Homo sapiens
cttccccaggaataaagatttaaatcacaccagctcaatgctggttgagggcaagggaacaatgaatggcttgtggaaggggaaagttaaaaatgcaaattacaactttgtgccccatttaaggaaagagaacttgaatagctatgcatatttgtgttttcttccttgctttgttatgtacatatttgtatatatcagccactaacttcttatctttccttcattcttcacttactaatttacataaggtactggtagttcatataaattcatttttagagactaaatataaaagcagaattgcaactgaacttaagcaagaatcattatcacccagggctagatttggtgactaatagaagtttggatctctatttttagaggagggattgagaaaatttttgtatggggaataattctattctattagcaagaatcgtgttgttttttgccattgctgctaattaaaattttaaatattgtcaaaagtggtata

SEQ ID NO: 261991 - DNA, 230 bp, Homo sapiens
ccacttccacctctgctctcctgtccacatgtcccacacggtgcacgaggatgtcatgtgacaacttgtcagtagctcattcaaatccatgcatgttgcaccagttcatggaaggaagcgttctgacttcacttcttactgaactcatgttcaatctctgtgatattttcaactaagtttcttgttactaaaatgagacttaaattaataaactttcatttctctcttct

SEQ ID NO: 261992 - DNA, 2721 bp, Homo sapiens
  misc_feature (331)..(331): n is a, c, g, or t
  misc_feature (961)..(961): n is a, c, g, or t
  misc_feature (2591)..(2591): n is a, c, g, or t
  misc_feature (2627)..(2627): n is a, c, g, or t
  misc_feature (2664)..(2664): n is a, c, g, or t
aaaggttcctgcggtgctctcccgtccagagccctgctgatggggaagtccgaaggccgtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagcngccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtnctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctncacagacacccgcggggctcagtgcccccgtcacanctctgtagagacaatcaactgtgtcctgcccaccctncaaggtgcattgtcttccagtatctacagcttcagacttgagctaagtaaatgcttc

SEQ ID NO: 261993 - DNA, 380 bp, Homo sapiens
cccctccctccagttacaaaagttaaaaatatctccagacattgccaaatgtctcctggggggccaaatcaccccctgtcaaggaccactgcaataggggaatagtcgtcagcctcccacattgtttcaaaaggattttttagtagatgttggaaagagaagctgtgcactgatcttcccagaaggaccacctagtaggaaataaaagccagtctcaaagtcctcatttcagagttggtttctctgctaaagcactaaatctttgatgctgagaagacaatgtatggtactactgtgtggcagaactagtgaaaatactgtaagttgttgaagacatttgtaaatatatactataataaaaactctacctcacaacagcc

SEQ ID NO: 261994 - DNA, 398 bp, Homo sapiens
ccctgcttgcctctactccctcgagaatggagccgccattttgtagcagctttctagagaagtttttttcaagagcactttgagagttgacagtctgacttaaactgaggtccatgaaagctgggttcagccagagcagggcagaggatggccagaggagaagagggcagagagacgatgggaagacaagacgaccctctctgctgagagcttcagagacctgcagagacatccaaatgacctgcctgcagagaggagccaacccctccagggcctcctctctgctgagagctgaacactccatgggatgatctgcctgcaaagaggagctacccactgtgggtctcctctgagctgttttaacactaaataaaactcttcatcttcttcacccttca

SEQ ID NO: 261995 - DNA, 657 bp, Homo sapiens
tgctgaatgtttatatagtccatccaatgtcttcttcagttcctaaaagaatgctggaaacagaataggcatttaataagtattcttgtgttttaaaaaattatttgaatttttacaatgggagcccttcatcacagctttgtagttacctcaactctggctgttgagtaatttgctcagttaaatctgtttgtgggtgtagtgaattacaacctcctctggttccctcgagatcaagtctaacctggtgattgcgtcatctggtgggagagcacggctacaacagcaggtggaaaccatgctcgggtcctggccactttgcctaggatgaaagctgttgtggcaaacaggggaaagagcttcaagctttgtagtaaaaggaatctgggcttaaattcctcttatcagcactgtgaccttggagaattaatcattcttggttgtggtgagggttaattgagatcaggtatttaaaggacatctgacagtgcctggcacgggataggtgctccataaatgcctgtagctataattattactgttccactagctgtttacttaagtaacattgaatttccacagaatgcatttcgaatcaggtggactatgattatactgatttttaaaataaagagctgcatctgttaaaggattcta

SEQ ID NO: 261996 - DNA, 262 bp, Homo sapiens
tattcctgcccaagatacgcacagacttctccgtgatcaataccctgcactgaagtaataacttgcaactgacaaacccgcatggacacattaattgtttccttttctggcgtcccctagtataacaagcctaaactatcttgaaacaccccgggttcctcaagcggattactgggaatgatgccaggtagagggaaagtgggtggggacgttcctctttgcactctttcctcaagaatccataaaatgtacattgatttgg

SEQ ID NO: 261997 - DNA, 703 bp, Homo sapiens
tgaaatgagttaagactttgggggactgttgggaaggcagagagggggactgtgatgtgcagggcatccacgccccatggctgtgatgtcgggcagcctgtgcccaggaagggcagctggcacagcaaggggtggccagacatgtgcattcctaccctgagtgaactctggggtgagagggtatctgtctggaaggagcaagcatcggtccttttcccacagtcctctcagcaaacacaatcactggttcaaggtttggatgcacctgtgctcatgggctcagggaccagactccctcctctggccagaagcctggcaccatctgcctggtctgcccccactttagggacgtgggctgtggacacagcacctggtccacaactcccgtgtcagaggtaattgcagggagatattccttagaatggtgagacagattttattccttaattcctgacagtaggggaaggagctgtgttccctgccagttcagcagaggtgacttttggatttaaagggagtatgattagctgggcctggtggcatgtgcctgtagtcccagctactcaggaggcttaggctggagggtcacttgagcccagcattttgaggctgtgatgagccttgattgcaccactgcactccagcctgggcagtagagtcagacgctgtctctaaaaaataaaaataaataaataaataaata

SEQ ID NO: 261998 - DNA, 570 bp, Homo sapiens
aggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcag

SEQ ID NO: 261999 - DNA, 699 bp, Homo sapiens
cttggaactggaagaggaagcagagatgggccaccctccctaccagcatgaagagatggaatatgagtcagatgtagtgtgagtatagatgtgggttccatcctgcttggcccttcctggcttgctgactttaggcacttcccttccctcctctgctagtttctttttttgtaaaacaagaaggttagaatccttgatataacacgtttctccaaactctacaacttagggctttggtgttcatttacagaagagcttgccctgtcaggcaagctgtctgttctaccaggcagatttggaaatgcttcccaaagcagatagtgtgcaccttgaatggtggtggagaaatgtcttggagaataagcagggcttggcattatagtcagagagcacatgctgagagtgagtgggaagagggtctgggaaggaattcagaagaaagagtaggttgggaagcagacggaaaaagaggagagtgaagtagagaaggcaccatagcaaaatgctccaggtcctggggagtcatcctgggttgtcccacagcaaaagaaatgtacagttactgatggacattgagaaggagaggtcaaaggggccttaaatccaaggatagaagggaggcagtgggggactcagacaagaccccaggaacatgggctctgtaagttcctactcagcctgacctcaagcaagagactt

SEQ ID NO: 262000 - DNA, 661 bp, Homo sapiens
ttagagagttcaaataatggccattgagctctgaattttccttggtgtcattttgccaatcacttaaaaaatgtgcatgagaatgggccacaatatgtaactggctggaatcccagcacaccaggcataccttaatgtgttagaatctcattcaattcttattaatctcttgagagcaaagaaaatctgcaaatccagccagggaatgtcaggagtttagaccatgtttgagatggcggtggctgccctgatggcctttagttagcaattctgcactcaccatttagaatgtttatttttgttctcagaagatttttaaaaaccatcaaggggaaagactcaaatcaagtcaaaaggaaccaaggtaagagtgttcacaaaaattttaacctaggtgtccacatagaacaaaatgttaaaccaggcatgcagatcaaaagtgaattcacaagtaaacacatgccttacagagagaatgttaattctgtacaaatcagagcattcaacccagaaagatttatgcctttgtaccagaaaggacttagcagaaaagacaaaaaggctgtttatcatctcgggctggatgtgtggtcctttatcaaggcagcctcatccaagtcacattctgagtagcatcaaaaagcctccagcacaaagagaa

SEQ ID NO: 262001 - DNA, 402 bp, Homo sapiens
ctggcctgatgtccaccttgggatggatgtccacctggggacagatgttcatttgtggcctgagtgtccatctcgtatctaatgtctacctggggcctggtgtttgcctgaggccttatatccacctggggcctgggcatccatttgaggcctgatgtctaactaagacccggtgtttaattggggcacagacttcttcctggagcccaatgttcacctggagcctgaagttcacctatgcctgttgtctacctgaggcctatgtgtcaacctagcgcctgaagaccaccctgagttcagtgttcacctggggactgacatctgcctggagtcctggtgtccacatagggcctggtattggcttgggaccaaagtatttacctagggcctgggtgtctactt

SEQ ID NO: 262002 - DNA, 240 bp, Homo sapiens
agaggcaaaaggaagatgagcctggaggcatccaagagcctgggattcagggaattgccacacctttctgtgcagagcacacaggatcagtagaagttatgagatgcggactctggcccatcagtagcgatctacccggatccctcaggaccatgccccttaatcctccctccctgcttctagcatatttaattaatgtcatactctctaatttttttacctgccctctcactaaaaaaa

SEQ ID NO: 262003 - DNA, 660 bp, Homo sapiens
gtctgtaaatcctgaggaaaatgtatatcttttcctttaaagttctaattcaagacatggatgtgagagttctgaagggactttgggactgcggtaaaatttcgttgtcatagtaacagaaagggaaataggcctagctcacctgggactttaacactgcaaaagctggattttttttttttttaagggaaaggactctgcaagtgaaataaatgaaaaacttactgtattttgaaacaaattttcaaacattaactaggtgagttgctgaaaaggccacttctgccatttttcttggttaacgtagttgcctgatgaaagatgcccaattttaaaattgcacagataggccatttaagagagaatattggcttcaagaaatatatatgacaaatgctaacctcagaccatgattctgtgctttcatgtttctctgaataatctatacatgaactgagaggatattcacacttcttattaatcataaaaactctggcatatacctgcacagatggactttgtctttggaagataacatatcattttctgattttgtaaacattagttgaatatatcaggccaccttcacgtatgagcatgaaggtgtctggggccagtggagagccacacagacgagacgccctgggattctggggccgg

SEQ ID NO: 262004 - DNA, 649 bp, Homo sapiens
  misc_feature (36)..(36): n is a, c, g, or t
gggtttgatattcctcttggtcttcaaggcacaagntttgacaatcatccttcacaaagacttgaagatagagacatggtagggggagatataaggatgctatattcatagcaaagtaccacagactgggtgccttgaagaacagaaatgtattgtctcacagttctggagactagaaatccaagatgtcagcagggttgtttccttctgagggcgtttagggaaacatctatgaaccaagagggaggacatcagatcagccaccatttcgatcttgaacttcccaggctccagaaatagctaaaattctataaggggcgagaaagaaccatcaacaatcaacataacagataactacattatgtgatattttagaagttgatagcctcattaaaaaaagaaagaaacagtagagcagagtaaggaagataataagaatctagtggccagaagaggcaaattgtagtaataaataagaaggtccagataggacgcattgagtcagtgacatttgaccaaaattttgaaagagaagaaatgtttcactaattggatatctgcgagcggagcattccaggcagaggggactgcaagagcaaaggcggttgctcaggagcctgcttgcggagacatcaggagcaacgttagc

SEQ ID NO: 262005 - DNA, 578 bp, Homo sapiens
tattttttccagttattacattgagaacaaagttatatttgcaaagttaagatttttataactatccctaaaactgattctcagtgactcccttgatctacatatgttaaggaaaaaggcaaggtgaagatgtgttaaatattttccagtttttaataatcgctttaatataaggtatacccaaataatggtgaattaattgaccatgaaagtacgttatagcagatgcccactcatcagtatgccttgaaattaaaggtttataaggtgcataagggcaaagtttttgatgttgccattacgttcacaaaagtatctcaggcacatacagcatgaagttcagtaagtgcttgcaacataagcagcactaaattttgttgaataaataaatacttttgtatagcatctgttcaaaatctctgatgtaaaaatgaaaataatctgaaaatatgcaaaaccgaaatttcccatataggactgccaattcatacaaacaataagatgaatttcaaaatgagaacatgacagtaaaatcaagtttcaaaatgactggtcttttttagaaaaacccatgttca

SEQ ID NO: 262006 - DNA, 435 bp, Homo sapiens
agcatttttcacattaggcaaaaggtggaaacaacccaagtgttcataagcagatgaatggataactgtaaggtggtatatacacacaacatagtagtatttagccttaaaatggaaagaaaattgtacacgtgctacagagtagaaccttggagatgttatgctaagttaaatcagtcacaaaagcagaaatattgtatgattaaatttatgtgagacactaagaatagtcaaattgataaagacagaaagtagaagggtagttgccagaggttgagagggaggaaggaatgaggaattactgcgtaatggatacagagtttcagttaggaaggatgaaaaaagtttctggaggtagatggtggtgatggctgcacaacaatgtgaattttttatttgatatatattttaccatatttttaaaaactctattac

SEQ ID NO: 262007 - DNA, 644 bp, Homo sapiens
ttaatgtaagtgctataattgcttagaatgtataatttggtaaagaaataaggccaacacctgagacagagttggaacaggatctatatgaaaaggtcctttcatgacagcaggtgtctctctttctttctgattcacacacatccagaaacctttaaactactatttggtgacacctgacagagagcaagacctttccttcctctaaaacatagctatcaatttaaatgttaaaaaagtacctaaacttatctcatctatgctctttacaaagctgcaaaagggaattttctgaccaaatacctgggctttggtgtagttacatttttttctctaaatgattttaactcctttatttctctttaatgcctgtactgcccccatccctctgcagggtgcctgtgtagctcagtggactctgcagccaaataatggccaagtaacggctgtgacttctcacccagggctgacaaaccacaatgtcaagggtacatattcaatgagagaagatgatttctcaacatcttgccctcaaattctagaacttcctcctcaatacttcttggagatctaataaaaaaatgtatctaatctattccctccagtgggatattttaccttggttattatcacaactattttgc

SEQ ID NO: 262008 - DNA, 422 bp, Homo sapiens
aaagaacccacagctgttgtaaaaccttacactctccagaatgcttgctccctcttttctccctccctcatccccaacagatggctgcaagtgcttcccttgctgcttccaggtgactctgagatagagagattatccaatgtatgctgtaccaaattctgcacgttgtctgcgactgttatagaaatttagatcctttagttgaaaccttcccaatcaaaacaaataacatcttcttagccttcttgatttcagggtgagccacatatttgaggcccaataggacccaaattttaatcggtgcatgatctaaataagcgaagagtttatccatgaaggcctatgcatgcctgtgtgtgttgactgatgaatgaggctactgagagagattagaaaattagaaatgtttgcctgctgtgagc

SEQ ID NO: 262009 - DNA, 695 bp, Homo sapiens
acacgggaggctaagagaggagaatcacttgaacctgggaggtggaggttgcagtaagccgagattgtgccactgcactccagcctgggacagggtgaaactccgtctcaaaaatgaaaagaaattacagcttgttgcatttccatgtactatcaaagaataaccacaatggtcagaaaaaaactatctaaaaacttcttccagctacatatctgtgtgaagccagattttcttcatatccttcaactaaaacaacatattgcaacagactgaatgcagatgcatacatgagaatctattagctaaagctgacgttaaagaaatttgtaaaaatgtaaaacattgacacccttctcattatattttttgttttggaaaatataactgtttttcataaaaatatttatgttaatgtacaataagtttgctgttatttagttttaaattctagtacagtaattgataatacacatattccacataaacgaaagctcattagtttttaagacttcttggtttgagaactactactcaaaattttttgtttgttttgagagagggtctctgttgctcagactggagtgcaatggcacaatcatagctcctgactataaactgaacctcctgggcaatcctcccatctcagcctcctgagtggctgggactacaacacctagctatttttttttttttaa

SEQ ID NO: 262010 - DNA, 253 bp, Homo sapiens
gggcacataagtgaagcaaagtgaaaggacacaaagtggtggggggcacgggggaatggggaggctttatccatgcacagacaccaagaaagacgctgggatgaatatgactggctttccggagaggaagtgtctttctttctctctttctctctctccctttctttccttcttttccttttttttttttttttttttgagacagagtcccactctgttgcggaggctggagtacaatggcgcgatctcggct

SEQ ID NO: 262011 - DNA, 1166 bp, Homo sapiens
  misc_feature (1166)..(1166): n is a, c, g, or t
tgcacaagcagaatcttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatccn

SEQ ID NO: 262012 - DNA, 619 bp, Homo sapiens
agattacgacctatcggggcatgcatagaattggatatgttccttgttattcgcgtcagcagtcactcatccaaagaccccaaagcttctagtgttctaaaggctcacaccttctgtgacaggaatcttgattcccattcttctcaatcaagacctaccctgaatggatttggagtagtgtggtataatgggaaaaattcaagcttgggggccaggcagatccaggtttcaaacccatctctgccacttcttacctctgagacctttggcaaacattttgacttaattgagccttagtttcctcatctataaactggagatactagcaccaaccttccagaattgtgtggattaaataaaatcaaggacatagattttgtgagcacaggatacttagtccagttcctggcacataatgaacgcattatgtaaatataagtttctcttccttatttcctgaccaccatgaacctagctctagtttctggccactagtctccatgacaacaactgaggaagagcacccaaacaagaagaagaaaaagaatgttttgccaaatatgtgaagatataatacctatcaccaaagactttaataagaataatgagactccacact

SEQ ID NO: 262013 - DNA, 224 bp, Homo sapiens
aaagggctattttagctgggtcttgaagaatgaagaaaagttctccaggcagagaggggagatggcatttggggcggaagaaacttgcctgttcaggctgggtgtggtggctcacacctgtaatcccagcactttgggaggccaaagtgggcggatcacttgaggtcaggagttcgagaccagcctggccaacatgctaaaaccctgtctctactaaaaatacc

SEQ ID NO: 262014 - DNA, 110 bp, Homo sapiens
gcttggcagatgaagagattggaagtgaaccactgagatgactgatgagcgtcctcagcaggctgtgttgcagggggaagagtgcaggttgtttataaggcctgggtcgt

SEQ ID NO: 262015 - DNA, 616 bp, Homo sapiens
gacaccaaaagctgcagcttccacagagcacagggaattgcaaataactgtcttctatgaggagctgccatttgtggtttcaccagtttcccagcattgcttctttgtaactcctggttcttgtattagaagaggatgctatgtccatgaagaatgtaggtatcaagcatgtcctttgggagcctccttgctttaacccctctcaccccttccaccccgccttcattagtaacccatcacctgggtcttcatatcccaactaactacagtcttggctaagaaaaccccatacgccttaactcagcaatatgcctcactatgtctttgtccattcagttatccattttgcaactgtttcttgagtgctgcatatgccaggtcgtacaggaggccaggtctacaaacaggacaagatggagaatcacagtccccgtggagctaataggctgttgtgagattcaggccggttagcctgcaagtgaaatgggatgtgctgagagctgtcctggggaagggatggtgaggtgtgagagcacgcagaggagtacagggtggtgagagcaggctccccagcaggagtagagaatgtgagggcggtgttgtgagaaagtgactc

SEQ ID NO: 262016 - DNA, 237 bp, Homo sapiens
ccttgctactacgcgaagacacagctagaagatgccatttatgaatcagagatcgagctctcaccagacattaaatctgctggtgccctgatcttggacttctcagccccaagaactgtaagaaataaatttatattgttgtaagctactcagcttatgatattttgttataacagctcaaataagccaagacaataaccaaaacatgtaaagaactcatacaactcagtagccaaa

SEQ ID NO: 262017 - DNA, 702 bp, Homo sapiens
gggcttctcattgcctgaagctggacgagtcagccactgggaggtctaggcttggtctctagcccaggctcagcctcagccttccagtgtgcatcttcctctctgggtttcagttttcctacctgtaacctaagttggactagaacatttccaagttcctcccagccctgtaaattctatctttgatacttatcttagatctttacaagggcttagcagtctcctaaaataagggaagagagttgcttctactctagcaaaaaaaaagttggggacagatgaaggaagaatgggtgaaatgttggaaatttgtgaagctgagtgagaagcaggtgggggttcattatgctactttcaccattttgtgtaacttaaaaattttccctgataaaaaaagtttttataaaatagaagttccattgaaattgagtgtctttacagcctttgttttctggtacccttgggaggcatccatccgtttaataaaaggtaccttccacaggaaactcccttcctttgtcatctttggtatccccatctccatcttccacaacagacagtttgaacagccgcaccactccagcatcaggacagtttgggggggtttccagaatcttctattcccacttcccatttctcaaatcatttgacctgtcgtacgtacaaagtaaaaagtcctagacaagagccaggagaggattt

SEQ ID NO: 262018 - DNA, 594 bp, Homo sapiens
ctgacctgctgttcaccgtggccttaccgggaagggtggtgtgttatgtgctgggctccagctggcctttcggcaaggggctctgcaggctgacggcgtttgtgctctacaccgacacctacggggggtctacctcatggcctgtgtgagcgtggaccattacccagcgtgagccactgcgcccggccaagtctgatgccatttatggagcattttgacgtgggtgattttgtgtttcgtaaagcattaggttggtgcaaaactgctgttctgccgtgacttgtgcaccaacctaatagaatgtgtgctttcctgccaagcgcatgttcctgacgacagtccctggcctttccctctgcccccaccgtccccccacactccggcggttcagacaggaataagcgtggagtcctgcctcaagccctccccagtcgctgtcccccagagaccctcttctctcctgatgcttcttgcatcttccaatttccggctacgttttggacatttgactctcttcaaggcagaacttcacatacactttcttgagtggggaatgtctcatcctgtgacgttgtgataaaataagaaatacgt

SEQ ID NO: 262019 - DNA, 262 bp, Homo sapiens
catcttcattatgtaaaggtataaaaggctgggaagtgaggacaaagaagtcccctcaggggcacacagctgggaagtgttagagctgggattgggaaacagttcaagaacgtcccaccgcagaataccaaaggcgagtcccttggattatgaaaagctttgattttcttccttgtaccattatatttttaagattgtctttaacgcacagatgttacttcagcaccacaaggactgttgatggaataaacaggccgactta

SEQ ID NO: 262020 - DNA, 576 bp, Homo sapiens
cttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccattttacattgactgataaatctcttttttccataa

SEQ ID NO: 262021 - DNA, 255 bp, Homo sapiens
catggatggcagggagaaccactgtgttccctaaatgcaatacgacccaaatatcttcctttttcatttttttgagatgcagtctcactctgcactccagcctgggcgacagagcgagactgtctcaaaaaaaaagaaaagaaaagaaaaagaatcgacatgttacagttttcagaatgttttgcatattttaaaaatacgtagtccaacatgaacagttaataaaagtacaaacagcgaataaacatatgaaaa

SEQ ID NO: 262022 - DNA, 669 bp, Homo sapiens
acaggcatgtgccaccatgcccagctaatttttgtgtttttagtagagacggggtttcaccatattggccaggcctgtctcaaactcctgacctcaagtcatttgcccacctcggcctcccaaaatgctggaattacaagtgtgagtcactgcgcctggccaagaatgtgcactataacaagtcaccaggtaatgcgaatcccagggggttccaggaccacgctttgagaaccactagtctatcctgatgtttgcactgtttaacatagaagttcaaaacccgggctttacagtctgtcagacctggtttttattcctaattccatcaattaatagctatgtgaacttgggccagtaactcaattaatctgagcctctattttctcacaagtagaataggaataattgcagggttgttctaagaaatggatcatgtaatgtgtaagtgcttacacttatgaagcattgccagcttcataataaacatttaatacatgattattagtctttctattcaagccctacctcaacaccctcctggaatctttctgcacctgttcctattgatctcttagtcctctaaaatgttggttcacttgctttccaacccgctctgtggtaaggaaactccatttccccacccccatagagcctcccgactccactagc

SEQ ID NO: 262023 - DNA, 367 bp, Homo sapiens
gagactagaagctgcaaaagaaatctaaaaacgtctcctggcacttgtgaatttctgatctaaggtttctttggagccattagtgaaacttctgaaattttgaagaaatttactgccttgattattaattatggttatcattgctgttttactctgtgggccaaggacaacgccacaagctcaaaagcagacttaagtgttttttgaacacagcttcttaactccacgcttagttgatttaatatttaagtgataagaaaatgcagtcgatttctggccctttttattgtttgggatgaagtcttgccctgttgcccaggctggagtgcagtggcgcgatctcggctcactgcaacctctgccttcc

SEQ ID NO: 262024 - DNA, 474 bp, Homo sapiens
agtaccatgaatattaggagagtatgcagtatagtcctttccagtgcatagagtgacttgctgtggggccagaacaagtcactcctgactcctgtgtccactgcgacccgtctcctctccactttcaaaatgttccctcgactgctgtgatcaccacctggtcaggggagaggaaggaaaagtgttgttggcctcactcatcaccccacagccattgagtgaacattcatgcatatgtgcatatagacgtactccccttcacgtgttcaagcgtgcatacatgttgccttgagggtatgcagctgctctcttaagtttcttagaaagagagtctgaagtagtttctcgttcaagtgatttattgttggggagcaggataggatggggggatgctaagcaaaaatgtggtctcagttggagactgacttcctgcaggtgaggctcgggagcatgaattgcatcacagagttcatc

SEQ ID NO: 262025 - DNA, 342 bp, Homo sapiens
tgctatgggaaggtcaccggctttagcaagcagctacaccaaagatcaaaatttgactctactctctattaacttgggacctatagtaaattgttctccaagcctcattttttttttttttcatctagaaaagcttcagaggataatgggacatttataaataatgtacctaaagtatctagcatagtaaggaatattaggttttctccttttcctcttaaacattatttagcattctctcttacacactagagaaacctcaccagcccacttatttagaaattatctgaaatacttttgaccactttgagcttcagtgttcacatctgtatgtctttaaaa

SEQ ID NO: 262026 - DNA, 211 bp, Homo sapiens
attttttttctgtggtttaaaaatgttaaaaacatttttcactggcagggtcatactgaaacaggtggcagctggatttggcccattgcccacagtttactgactcctgctttaacctgtacttgtgaaaataagacatataacctctttgcttacatttcatttttgagtactttatcaacacgaactcatgaagatcagtggaagcatg

SEQ ID NO: 262027 - DNA, 1034 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262028 - DNA, 528 bp, Homo sapiens
ggcaggagttattgccacagccacacacgacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262029 - DNA, 611 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262030 - DNA, 491 bp, Homo sapiens
  misc_feature (2)..(2): n is a, c, g, or t
  misc_feature (10)..(10): n is a, c, g, or t
  misc_feature (12)..(12): n is a, c, g, or t
gngcaggggncnacgagcggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcaaccatagcaagccactagaaccaaggcccagctggcagtgctgatcgatcccacatcctgaataaagaataaagatctctcagaaaattccaa

SEQ ID NO: 262031 - DNA, 340 bp, Homo sapiens
  misc_feature (12)..(12): n is a, c, g, or t
aaaaagaaaaanaaaaaaacccccccccccacgggggggtgggtgggggcccctgggaaaaggggggcaccaaaccggctccggggttgccaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262032 - DNA, 1290 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaaaaaaagaaaaagacaacaacgacaaaaaaaacgttgtttgggccgcgccgtggcccctcgagaaaagttcttttagaacacatgcgttgggggcgggcgcgccccgttgcgtgagggcacctgggccacaagcgggtccagggaaatccggcccagcaccgggcggggtttcctccccataaaaaagccgcgcggaccggggctcgaaccactccgggggtcgagcctacggcctacggccagggcgatatac

SEQ ID NO: 262033 - DNA, 1224 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaacaacacacaaacaaaaaaaaaaacaaaaccttgttgcggccgccgccttggcgccctcaggaaaaacgttttctaacacccctctccggtggggcgcgcgggggcccccgtatgggttagctgcgccaccggggccaacacgcggggtccccaaagggagaaccccggggccaggaacaaggcgcctg

SEQ ID NO: 262034 - DNA, 1416 bp, Homo sapiens
  misc_feature (1416)..(1416): n is a, c, g, or t
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaagggggggggggcgccgcgggcccccgcgaagaaagtttttaaaacaccaatgcgcggtgggggcgcgcgggggccccaaaggaggaaagagggacacacggggcgccaaagagcgggtgttcccaggagggaacaccgcggggcgcacagcagacaaaggggcgggggattctctccacacacaaaataaaaaagcgcgcgcgggggggaacccgagggcggtctgggaacaaatcctccgaagagggggaggtcagagaaggggcaccaacacgggggggccctaatcacccggggaggccaaagggaggccccggaatatcaaaattaaggcgcccgggcccggggggcgn

SEQ ID NO: 262035 - DNA, 1171 bp, Homo sapiens
gagtgagaactgtggccttggaccatgggagacctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaaactacagggcaacaaggcaccagagtcccggacttaggaccactgtgtgtgattcaccgtgaacactggcatattaaaggctctgagaagtcctgtaggaaaggacaatttgactttgtttgagctcatattttccaatcccatctgacctttagttcttcactgagtgcccactgggttatattctgggagccgaggccacagcagtgaacaaagcacacaaaaccc

SEQ ID NO: 262036 - DNA, 947 bp, Homo sapiens
tttttctagagatgaggtcttgctatgttgcccaggctggtctcaaactcccgggctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262037 - DNA, 896 bp, Homo sapiens
  misc_feature (2)..(2): n is a, c, g, or t
  misc_feature (10)..(10): n is a, c, g, or t
  misc_feature (12)..(12): n is a, c, g, or t
gngcaggggncnacgagcggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 262038 - DNA, 377 bp, Homo sapiens
tcattacttcattatactctgttagctacaatatagatttgtttgctctaatagaaccccccaaaatgttattcagcatgccagaagtttccatacctctgatgtggaagtccaagctggcacagggacactcctccccaaaggggtcagagacctaggctctgtcttattctatcatactcaacacgtggcttccatttcatgatctaagacagctgctgcagttcctgcaatcaccttcacatccctgctcataggaagaagaaaagggagttcaggcccttctctttaaaggccattctgtggacgttgcatctgtcacttttcacatcccagtagccggaacttggtcatagaatcacacctagcttcaaaag

SEQ ID NO: 262039 - DNA, 205 bp, Homo sapiens
gttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttg

SEQ ID NO: 262040 - DNA, 409 bp, Homo sapiens
acatcagcagcactggggaacttgttagaaatgcatattttcaggcccaccccagacttactgagtgggaaactttgggatggagtccattattgtgtgttttagcaagccctgcaggccattctgatgcataccttttaagaagatgtacttcttccagccaagggaagattgaggaaactttggcagagaactgatagtggatattgatattgattgtagatacatgtctaagaaatgagtagagacataatttgaaggacagtatgaaaaacatcatatgtattgtcaaagtagaaagaatacaactaaacatgagaaactaaggaacagagacaggaaaaactagaattaaattattaattgttgtataggtaataggtagaagtcagagagtaccacttaaaac

SEQ ID NO: 262041 - DNA, 524 bp, Homo sapiens
ctgctgcacccatcacatccggctgctgctgctcgcatggcttcggggtatagaaggactcataactgccccaaatccccctcagcccccttcctaccatgtaccacatccgcattcactgctgtgcaggaatccccttactccttcctcacaacaccccaatggaagggcagctgttatcacctcatcttatggatgacaaaactgagacacagagtggactagaattttcccacatttcctggcgggcagagctgggactcgaactgaggtcaggctgctcccagagctcacgctaacctccaaaggcattcctcccccagggattttcaatgaggagggtggaggggtgccccggtcctcagctgcaggaggagggcttttgtctgggcacagacaatcccagacagactcttcagctccaagacatgacgatgggggtactgggaggctctcctgcatccagcgtccccattttacaaataaacaaaccgaggcccagaaaagggaagccaggcaccaga

SEQ ID NO: 262042 - DNA, 136 bp, Homo sapiens
ttgattcttatcaactcacatcagtttctgacattcagagatgtctgtgatcaaagctcatatgaagagaattctaaatgttgcatggcaaagaacccaagaactcctggcccaaaccgcatgcagctccccactc

SEQ ID NO: 262043 - DNA, 569 bp, Homo sapiens
gaattgttgagccctgaggttcgacatgaatcgtttatagtgtaactcatctccccaggtgaaggcatagagaagacagatgagtcttctgatctaggtttgtccaggtggaatttttgccaggctggtaagagaagaagacagattgacaaggaagctgatgaggctagccagagagtaactgtaatccagaatgatgtctattggagactttgcccaaagggaaaggaagtgaagatgggaggggatccaagtaaacgtggtgttctggtcaatgcagagaagggttatcatagtcatagtggaatgagccagatagaggaagaatgtggctgggaaaacaggatgcttaaacttgtagtttctggaggtggagcaatttcaggtttgacggtccagggaatgagtggctgtactgggttgagaacaagagtcactggacatgagaagtaagcgggaagccagggtatttaaaaagggacctgtgacttctgaagccttcctagcgaggcagggaatggcttggagaggaaggtccagccagtggcaaaggcctcagtgaacgaagg

SEQ ID NO: 262044 - DNA, 473 bp, Homo sapiens
tttttttttttggaacgaagtttcgctcgttgcccaggctggagcgcaatggcatgatctcagctcactgcaacctctgcctcccgggttcaagcaattctcctgcctcagcctcctgagtagctgggattacaggcgctcgccaccacgcccggctaatttttgtatatttagtagagaccgggtttcaccatgttgaccaggctggtcttgaacttctgacctcaggtgatccacccacctcggcctcccaaagtgctgagatgacaggcatgagccaccatacccggctgtcagtaggtacattaaatgcatttctgacttacaatagtttcgagttatgatgggtttttccagacataatttcactgtaagtcaaggcacatctgtacactgttaactagagactatctgagactccagtacccaccacaaggactagcacagagcaactgcccagtaaggatgggtta

SEQ ID NO: 262045 - DNA, 372 bp, Homo sapiens
gtctgcttttataatatttatgtggagtacaattattttaatagaaaatattctgacaggtcaccatctttcagaaactaagtcttttttttcctgcagatttctttgctttggctttttcccagtcactcacagggaggtatttaaatcgccacagaaaggggaaggtacctaaaatgatctgggagcctgcggtgactggtgagaactaacaggcggaggccgtgtgcgagggttgatgacgtctgacagactgtacctgtgcctttagcgtgtccacaggaagggcatctgcattcaccagcgcagggtgtgagagtgccacagagaagcagaaaaacattgctgaataaaatgaagatcattccaaca

SEQ ID NO: 262046 - DNA, 272 bp, Homo sapiens
caggtgcccccagggatcccgcttgttgtctgcaggccaaacaaccagccagggagcagggaaggctttggagcaccaatcaccacgtgcatttacttcctttccacatgtgccctcgacaactatgaattaggcacccacaaggcactggaggagggtggttaacaagacagatgcaaccccggcccccatgaacttacagccaggcgcggaagaaaagtaagtatcccattcagatcattaaagctgtgatgagagataaaaaaaaaaaa

SEQ ID NO: 262047 - DNA, 580 bp, Homo sapiens
tgtgactcagtgatgggccagtggaaacggctgttcccacagttggacagaacgaggtttgtgtcctggtgttgctcacagacgtctcaaccagacggagtccggactccaccacgtggcaataacgagaagatggcagcttcccgcctgggaatggagaactcgagtggccacccaggatgacaggcagcctccccacccaagggggatccttaagcagttggagtgggtcctggggccagcccagggctggcacggggttcgcatttcacttctgggccatggcaagctctggttcagagccttagctcggcagcagcccctctgcaccaagtcacttggcccctgccacagcatcacagcctggagcccaactggatgagcccagctcatgcttctgaagcacggctattctgacagccctggtcttggtgctcatcacttgcttctcactgtgctttacaggcagaatggggacaagagctttaagttctatcattgtgattcttttttttctgctgcagtcccttatatgtagcctccgaccaaatacaacttttgcctttgtgctattgctgga

SEQ ID NO: 262048 - DNA, 417 bp, Homo sapiens
ctctactgcaagcaaggctgtagacaggttgtagtgacctagcctgcaaaaatgagctccagacacccctgagcaaggttaaaagaaaaaaaacaaattcctttactgtctctcctgtactgaactattagttatgactatgtttgccaatgcttatatttagtaaaatttataaattcctgtttttctttcaacgtagctggaaggtcactagctatacaaggccacaagttatgccaagtcaacagttatgccataaattacatgacttgtaatttatgtaattaccgcctttgttttgctcttgtatactagcctatataagctaaactctgtctttgtttggggctcaggtttttaaatgtgaatccactgagccagtgcgtaccttaaaataaatatcctcctatattcacc

SEQ ID NO: 262049 - DNA, 797 bp, Homo sapiens
  misc_feature (377)..(377): n is a, c, g, or t
  misc_feature (386)..(386): n is a, c, g, or t
  misc_feature (410)..(410): n is a, c, g, or t
  misc_feature (421)..(421): n is a, c, g, or t
  misc_feature (437)..(437): n is a, c, g, or t
  misc_feature (489)..(489): n is a, c, g, or t
  misc_feature (524)..(524): n is a, c, g, or t
  misc_feature (739)..(739): n is a, c, g, or t
  misc_feature (745)..(746): n is a, c, g, or t
gatgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactggtgtgtccttcaaggctgttggtctacaacctgctggagatgtaaatttgccatgacttcctggaggacagcagcatggagaaagatcctagaaaaggcctctgacttccctcacctcccaacnatcattacnggaaagactgtgaactcctgagtncagcttgattnctgactacatcccagnaagctctggcatctgtggattaaaatccctggatctctctcagttgtgtatntgtcatcttcatatgctggcaggaacaactattantacagatactcagaagccaataacatgacaggagctgggactggtttgaacacagggtgtgcagatggggaggggggtactggccttgggcctcctatgatgcagacatggtgaattttaattcaaggaagagggagaatgttttaggcaggtggttatatgtgggaagaataatttattcatggatccaatgtttgtggagtcctttctttgtncaaggnnctgcggtgaacaaattttaagtggagtcatgaggttaggatgaagctattt

SEQ ID NO: 262050 - DNA, 758 bp, Homo sapiens
gatgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaaccaggagcggacaagctgcagaggtatcagaccttcctccaggttctgtatacctgcaggataggtgtgtcctggagtgatgtgtagaaaatatcaaatgataaccagagcgattaccacgg

SEQ ID NO: 262051 - DNA, 832 bp, Homo sapiens
  misc_feature (524)..(524): n is a, c, g, or t
  misc_feature (559)..(559): n is a, c, g, or t
  misc_feature (774)..(774): n is a, c, g, or t
  misc_feature (780)..(781): n is a, c, g, or t
gatgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctgaggcagagaatcttccagatgataaaccccagcagcggacttgaccccaggagcagagtacaggagacaccatggggagagaccctggtgtgtccttcaaggctgttggtctacaacctgctggagatgtaaatttgccatgacttcctggaggacagcaagctctggcatctgtggattaaaatccctggatctctctcagttgtgtatntgtcatcttcatatgctggcaggaacaactattantacagatactcagaagccaataacatgacaggagctgggactggtttgaacacagggtgtgcagatggggaggggggtactggccttgggcctcctatgatgcagacatggtgaattttaattcaaggaagagggagaatgttttaggcaggtggttatatgtgggaagaataatttattcatggatccaatgtttgtggagtcctttctttgtncaaggnnctgcggtgaacaaattttaagtggagtcatgaggttaggatgaagctattt

SEQ ID NO: 262052 - DNA, 267 bp, Homo sapiens
aaaccaagacggtgaggaaagtgacctctggttgtcctcacagttagaaatgctatggcaacatccacaagttaccttatgtggtctatatttttaaaaagaattcctgaaaagctaataaataatccactccttatttagcatatgatcaaggactatctatacaaatagccgaccagcagtgtttggtgctgccctgtctatggagtagccattcctttattcatttactgtcttaataaacttgtttccactttatagactcct

SEQ ID NO: 262053 - DNA, 327 bp, Homo sapiens
tatttattcatcagcatccccttcaactaaatataagtgtgggcaaagaacagttacagacatggacaggcactcgtttctctagaattattaagaatcactggactgtgaaatatcagtgtttcaaaatttctgatttctcctgtgaggtacttttcatattttattttgataactgaatgcaaatgagcttcagggaaccctttctcacctgtgttctttgcatgctggtacaactgagtctgtttattaaggactattaacaaatacatagcccagtttagaattatacaaatcaactacattaggggagttgccaaaaaaaaa

SEQ ID NO: 262054 - DNA, 436 bp, Homo sapiens
atgtgtcatgcatacctgtgagggagtgtgtgagtgtgcgcacaggcgtaagagtgtgtgctttgagtgtgctgatgagtgtgagggtgtgagcctgtggggggttgcatggggccatgcctggggaggttgtgtatgtgtgagcacatggtgggatgtgactgtgtgcaggccacacaggttactgggggggtaggagcctagaaagagatgaatctggggtgaggggctgtgtgtccacagttctcgggctcctaagataccccaaagttgggcagagaccagttcatggagggtcttgaaagccaggcagaggaatctgggctttaacctcaggagccatagacagcatctaagcagttgtaacctggcaaacactgagtttcagaaggcccccagtatagaccagaaaacctctctctggcttgagtggaaa

SEQ ID NO: 262055 - DNA, 458 bp, Homo sapiens
gagtgatcctcaaaattatagcacattgtttcttaaaagaaataaaaatttaaaaacaaaacagatttgctcaagcctactgattctgaattttaaggataaaaccctgatgtccgacacatgtaacatatttcaaaagagggtatcatgcacattaaagtttgaaagccactcattattgccatctagagtcacctctcaggtttcagatgtgctagctcatgtacccagattcttaggaagctttgatctagcagaatattcagtcaggttttgtgtaggtgcattttgatgacagtaggaaccagtttcagtcaactctgggtggttggttgttgtttttcttacttaagactggccacaatataccccactttgaaatactttatattccatcatcagccaaaagaatatccttatgacataactacttatgacatactactaagtattgtata

SEQ ID NO: 262056 - DNA, 427 bp, Homo sapiens
tcccaaagtgctgagattacaggcgtgagccaccgtgcccggcccgccttggagatttaaaaacaaaaacaaaagcaaagtatttgctgtcctgagttgttggtgagagtgaggacaatccccgtcctccccctttcattccctaatgaagaccctgacccagggggaagaaaaaaattcaagcaccatataaatattttatacataagatttcagtgctccacatcttgtcccacgggaaagtcttcaggggccataacatgcatggagctgtcatctgctataacaacgccttcttctggaatacctcgtgaatgacctgcctgaggcaatcctgattgtgcccaaatagacatggataatactatacatgctgctccataacacaatatttcatggatgtcttcccaattaaatatataaaaat

SEQ ID NO: 262057 - DNA, 443 bp, Homo sapiens
taaatgaaataagctggcaaatcaaattcctcagtcctaagcaacttttaatatagcagttaaattagaactagtatccagaagagatcataaagaaaataaactctagagcaaaaattaaataataattaaacacaaaactttctaacagatgactaacataatggtatttaagctaactctgctatttttctagaacatttagaataaattctgaagctccaagaagctaagatcctatcaccaaactgtgactcagctgtcctgcccacagaatgtttgaagttaccaataaagcactctctcttccccacctgtttttataacaagttcctaagaatcttcagaaataactctttgctgacttttctctcctcagagactttaagaaaagctccttttctatccctgatctagttatctcttctgtgtacaatcttaaa

SEQ ID NO: 262058 - DNA, 514 bp, Homo sapiens
gccatcctcatattctggtcctacttcattattctcaataccatggtgcccatttccctctatgtcagtgttgaaataataagattgggcaacagtttatatatcaactgggatcggaagatgttttatgcaccaaggaacacaccagcacaggtgatacttatgacaaggatggacagagggtgacggtctctgagacagtttatgagacctggtttatcacatgctacagtctggtctacacttccctccctgtcctgtgcatgagtctgtttgatcagtaacccataaggaagctcctaggcagcctggcagcagacctggtgaggggagaagcctctactctgatggagatgggaccttctatggagagaccctgagcctccctccttaccctcgggtgcttccaggatgtgaatgagacatggagcctccatttcccagagctgtatgagccaggccagcacaacctctatttcaacaagaaagaatttgtgaagtgtttaatgcatgg

SEQ ID NO: 262059 - DNA, 454 bp, Homo sapiens
tcccagctgcctcccccatctcaagctccagtcctccctcccagctacccacaagcctagttgctccctttcataactccccaattctaactccctccaagtccttcccagcatcccgaacttctcccagcttccttccactacccagatccttgcctagagagtaggacttcaggaagggtctgtggtcactgctgtgttctctggttccacttctccagtaacccataaggaagctcctaggcagcctggcagcagacctggtgaggggagaagcctctactctgatggagatgggaccttctatggagagaccctgagcctccctccttaccctcgggtgcttccaggatgtgaatgagacatggagcctccatttcccagagctgtatgagccaggccagcacaacctctatttcaacaagaaagaatttgtgaagtgtttaatgcatgg

SEQ ID NO: 262060 - DNA, 346 bp, Homo sapiens
tagtggctatccacttgggaaggatatcccagtctcacatcccagatgacagtggtctgcctagtccaggaattcactgctggagatgacttaacttcagagaacattgccccagaccaatacttcaccattggagatgacttcacctcctgcactggagattactttaccttgtacgcttagcttccccaacaatgccaatgggctgcccctcctaaggcactaacaaatatgaaatgggatatttattgtgtttcttcctttgatattatttctttgatattaggaattctagtatgttttctgagctcactttttgctacacaatgatcctagtatataagat

SEQ ID NO: 262061 - DNA, 440 bp, Homo sapiens
agcaagaaaagaaatgcaaattaaaaccacagtagggcaccattacatatacaagctcattggcaaaaacttaagtctggaaataccaagcgtgggtgagaaagtggagcagttggaactctctacaaagcttctgagagtgcaaaccagcactgctgctctggaaggcagctcagcatcatctgccaaggttgagggtgtgtatcccctatggcacagcagttcctccgtgacgtgtgtactcacagacacttccatatatgtacaccagcataacgtgtgcaagaatcttcggtggcatgtttgacataaccccaatccagaacccaagtatttactgcaagtaaaaacacataaataaattgtggcatattcatgggatccaatattacacatcaatggacataaataaaattctttcattctaaacagaataacaa

SEQ ID NO: 262062 - DNA, 436 bp, Homo sapiens
ggaggtgcgttcattcatacttatgtaacaggagaaaatacggccatgaagttggtgttttccgggggcggtttttccattgtactcagtatgtgctgactgactcctgttacttccacatgtggggaaactggactgtaatttgtggtggtggggaattgcgttcgcgctttcttctggaggttgtagtgcaaaaagcagtttgtctaccaagtgatactttcagcttttacaaatgctgaacaatatccgtggtgtgttttcatgtcacctcctctcccttctttgttagaaaaaaatggaagagcgcgtggatgttttgagatgagaagaggtgcgttcaccaccttcacctccgtgtaggcttgttattaagggaaagggaacaaaggagtctcacttatgtaagatgaccttacatgagaagaagaaattc

SEQ ID NO: 262063 - DNA, 297 bp, Homo sapiens
tttcactctgcaccgtctgcacactctgccatctttaggcccaaaacgagccttctggaatcctcaggctttctaaatgctaaatatacagcattaatcggatcttgcatctctattgaataactaagacacctttatgttgaaatgcagattctccattgaaaggcaaatctttcatttcgaatgtttgaatgagactgggtttgtatttataaaataagttgtatagaagagcatattctgggcctggagtgctttcatttgattgctcaataaatacattttcactcatccaaa

SEQ ID NO: 262064 - DNA, 337 bp, Homo sapiens
agatcattgttgtaggggctgtcctgtaaattgtgagttgcttagcggcatctttagcctcttcccactagatgtcattagcattccctgccccctctccccagctatgacaaccaaaagtgtctccaggcattgcaaatgtcccctggggggcagaatcacccccagttgagaaccatttcctggagtcttcataggccgagctggccaaggcaaactggaaaagatgagggaggaattaaattgatgtggcttatataaaagcttgctgcctgataggttctccaaagttgattggttggttgaataaataatggagccaggtagaagggaacat

SEQ ID NO: 262065 - DNA, 365 bp, Homo sapiens
ccagtcaaaaggcatacgcagagaaggtaaattcatctgtgggtctggtgagagtcactgaaaaaaatgtagtgcttgaggactgtccaaggagagccaattttcaactcatagcctgtgatgctgcgcccaaacaatgagaacagcacactgggcttcatccaaccacggccagagggaaaacagtgatcttgcagatgatgtcctcatcgatagcacagtgaccaagcggccctgcatggtgggggccccttaaaatggttccccttcccttgcaggcctggtcaggtggtgtttgtaaagcaaagggaacccttttagaaatttgccttgaattaaacgattgttgttcatgagaccaagaa

SEQ ID NO: 262066 - DNA, 459 bp, Homo sapiens
caacaaagaattagcagcaagagtgaagtactcttagaaatcaataagcaagaggcaaaagaaagaacaggcatttcacaagagaggaaacaaatatgcccaataaacacaggaagagatgctgatcctaattggtaatttaaaaaatgtaaaacaagaccataatgagatattttatacccatttgatgagcaaaaattaagaagtctaataattccaagtattagtgaggcagtgaatctataggatctcataaattgcatgtagaagcatcagtacaatcaatttcaaaagcaatacagtattaacttgtaaaaatgaacattggttcatattacccagcaattctactctcaagcatatccacccaagagatattcttgttcatctgaacctggaaatatggattaaaatgttcataaaagcgctgtttggaattgaataaaactggaagaaaca

SEQ ID NO: 262067 - DNA, 323 bp, Homo sapiens
gaggatctccataatagaatgcagaagactaaggaaaaagtcaatgaacttgaaaacagaacacgaatacctacataatctgaactatagagagaaaggaggattttattgtctctgaacagaggctcagggacaaataaaaaataacaaatccaacattcacattattgtaatctggaaagaagaggacaaagtggtctttgtgggataaaactttgaacaattaatagctgaaaatggttcaaatttgtcaaaagatataaaccagatttttaaagttcagtaaatgtcaatcaggataaacccaaagaaacccatagcaa

SEQ ID NO: 262068 - DNA, 533 bp, Homo sapiens
gtagacctatatgtattaactttgaaagaaatttatactgtattgatgatttttcaaaaaacaaattgcagaataatttctgtttctctgtttgggttttaatatatttgtgtgtgtgcatgtacccagcatatacagagaggatgggattgtgtttctgtttaaacatacagaaaatgaaaaaaatctgaaaatatgtcatgcaaaggggacacaaataccactagtcatggattagcaatatgaaatgagctttattggtataaagtaagtacttgaagtaataaaacatttatctctgccccttgagttgcctgacccattcttctgcctctaacaactgctaggagtgttcttccagcatccccagtgagctcagtctcttggaaagagtctgtggcacatacaactcacaggaccccacctcaacattataaaggaggagactcacatacctaccatgtggccctaaacaatctagatctgattaaatttcaaggtcaaccatatttctaagacttcaatgatgtaaa

SEQ ID NO: 262069 - DNA, 336 bp, Homo sapiens
acttctatactctcttcaagacccagttcaaacacccctctctccgtgaaccagttccaatccccccaagcagagttcgtcacttttgttataagtggtacctggaggaacccttggcatccaagtgttcaccaagagtcagccatcccctaacctcagctacaggccccagttttcgtgattctctcttctcttttcctctctcactctttgcaccaggcaatctcaccaggttttcccaactcatgtcctaaatattcttagatccacttatctttgcctcatggtcattgccagagctatcacctctccaggattcctgcaatggtccccaca

SEQ ID NO: 262070 - DNA, 1204 bp, Homo sapiens
  misc_feature (1204)..(1204): n is a, c, g, or t
caaagaggaaatggaggttttgcctgagccccctcctccaataaataggaaaaaagacaagagctatgctacagctatgggaccctttcttaggcaagaggcattaagtggggagctcttagcctgcctggtaatacaagattgacagggcaattgggtatataaacccatttcttttaacatttataaaaagttaagaaaaagcattagaggctgaaaccgcgtggccaaatgggtggtaggcagaaggaaatacttggcagcaaaggaagctcgcagacctggagccagcaagtgcttccaggaactcagcctgcacagaggcagcagtgacaaggagccaggcgcagcacaccagagctggcctgatagggaggggcaggaggcgtgcacgaaggtccgcccagcggcagcagggtgagggagcagcacagacaaaaggtggcacagacaaaaagcagcgcctgagcaagcgcaacatgaccgccgccccgggacccgccggctagactctctggctccgcgggtggcccatggcaaaatttcatgtgttccttgtatacaagcgacatcccagattataattctctgctaagatttaagtacaatttaagaatttaaaacacctctttctaataatggccactgttgcttttacactattcccctggcaaagcaagacagaaaaatttgcatttacaataccagctatcaatattgaaaggtcagcttgccgatttcattggaaagtgcttcctcaaggaatgctaaacagtgctgccatgtgtcagtatcatgtaaatcaagctttgttccccagtagaaaagaatttcctcattgcaaggttattcattttatggatgatattctactagcagccccagtggagccagtgcttttaagtttatatacctctgtcataaagaatgcacagctaagtggtttaatcattgcacctgaaaaagcacaaatgtcctctccttggaagtatcttgggtacatacttcctggtcagtaagacctcaaaaggttaaattaaatactagcaacttacacaccttaaatgattatcagaaattactaggtaattttaactggcttcaccccaccttgggcattcctacttataagctgcaaaacctgttttctatcttaaagggtaacacagccctggattctcccagatatttaacccctgcagcn

SEQ ID NO: 262071 - DNA, 359 bp, Homo sapiens
gaataaccacaaaagaaagcaatttttaacaaggaaacataaaggtaatagcagatattaatgaaatgggaggaaaaaatgagatgatccacattaaatcaaaagctgattatgtgaaaatagcaatataggctgggggctgtggctcacgctcgtaatcccagcactttgggaggccaaggccagaggatcacttgaggtcaggagtttgagactagcctggccagcatggtgaaaccctgcctctactaaaaatacaaaaattagctgggtgtggtggtgggcgcctataatcccagctattcaggaggctgagacaggagaatcacttgaacccgagaagcaggaaaaaaaaaaaa

SEQ ID NO: 262072 - DNA, 396 bp, Homo sapiens
cctgaaagcagagagctctgtagttgctcaggaactcgggaagagctaacatatttagagggtcttaaaggaaatagggctttttgactccttgaaggattaatttccttatgtagttttcacataaggtgttttctctaagaaagttcaatcaggagatacactagtcccccttgtcagtgaggatatgattcaagacctccagtgggtgcctgaaactgcaaatagtaccgaatcctatatatactgtgttttttcttgtacatacatacctatgataaagtttaatttagaaattaggcacagtaagagacttctgaacagcagtaactactaaagtagaataattattgtaacaatatactgtaggaaaagttatataaatgtggtctctct

SEQ ID NO: 262073 - DNA, 370 bp, Homo sapiens
ggagctcctgtgttcaagcaatcctcctgcctcggcctccctaaatgctaggattacaggcatgagccaccaggtccagcctaatactggacgactttccttctatcttggaagctctatttatggctcaatacatgcgatgatttaagttagatgacaaagctaaaatctaaagtagattttgtatgttctactgtaaaatttttaataatgttatattttagtgtggagtagaaaatcgtgttggttttgttttttacatgtcaaaatgaagctttttagttttgtaattatataatgttgcagccaagaatgtaggtgttttttttttttcctctcttttctttttttaaaagacaggatcttgcca

SEQ ID NO: 262074 - DNA, 444 bp, Homo sapiens
tgtccggaatgtggtaaatgtgatttggaaaaccaaagagacatgatggtggagaataaggagagttgtcagaaaggtttccctgcagataaacttttaaagatctcaacctgtggacgggaaatgtggggttggagcccccacacagagtccccactggcacagtggctcatgcctgtaatcccagcacttctagaggctgaggcgggtgtattgcttgagcccagaagtttgagagcagcctgggcaacgtggtgaaaccctgtctctacaaaaaatttaaaaaattagccaggcatgagggtacacacctgtagtcccagctactcagggggctgaggcgggaggattgcttgagcctgggaagtggaggctgcagtgagcctaggtggtgccactgcactccaacctgggggacagaggaggccctgtcccgagtgcggc

SEQ ID NO: 262075 - DNA, 395 bp, Homo sapiens
gtccagactggtgtttcctaggttttcttcttggattcttatagtttgaggtcttatatttaaatatttaacttgtttcaagttgatttttatatatggtgaaaggaaggggttcagttttaatcatctgtatatggctagccagctgtcccagcaccatttattgaataggaagtcctttcctcattgcttatttgtgctaactttgtcaaagattagatggctgtaggtgtggctttatttctgggttctctgtcctgttttattggtttatatgtctgttttgtatgtccatttttatttctgttatgtagcctattagtatagtttgaaatcaggtagtataatgtgtctgcctttgttctttttacttagaattgctatggctattcagg

SEQ ID NO: 262076 - DNA, 124 bp, Homo sapiens
tggagaaggccgggtaactgaagctggtagccagttcatgttgagaagcagaggactaggtctacactggcgccctctgcattcaggtcaagggccaaatgggaatgtgcagaaggcaagggga

SEQ ID NO: 262077 - DNA, 687 bp, Homo sapiens
gcaatatctaatccttatatgtcatcagtcatgattggcaaggcagtgttccctatccctacctaaatcaacgcatttaatccttacaacaactttctaagtaagtagtgttacttttcgcattttacagataaggaaactgaggcatatagaaattctgtaactcgtataaggttgcacattttaaaaggtcagagccaagattcaagtgcaggcagcctgcctcctgaatcttgaggctttctggaataaaaataccacagagcagttcaggctgcatttactagattcttgttagatgcagtcctagctgtccgtagaggcccacatatctcttggggttatgtctcagacctgtgcttctcgaaggaagggaggaaggactttatttatttatttttatttatttatttattttttgagacggagtctcactttgtcgcccaggctggagtgcagtggcaccatctcggctcaccgcaagctccgcctccgaggttcacaccattctcctgcctcagcctccaagtagctgggactacaggcgcccgccaccacgcccggctaattttttgtatttttagtagaggcgaggtttcaccgtgttagccaggatggtctctatctcctgacctcgtcatccgcccatctcggcctcctaaagtgctgggattataggcgtgtgcc

SEQ ID NO: 262078 - DNA, 438 bp, Homo sapiens
gtgcgagggcaaaggaatagaggaatggaaaattaaggtggtagagggctcttgggggcagtgatccactaaaaataaacctgtaataaagtatcccatgatgaagaaaaatttgagaaccactgctttgaaatgattaggttagtagtccagcaggaactgtggaatattctgaacagcacctgatacactattagcgttcaaaataaagttaaatcaccccttcaaaagcagcagtaacaatttttaaaataaccttataagttagtggctcttgagccacatttatacatttgccattttctcatgaatccagtccgtcttcagtgtccgccctggagcatatacacatagcaaatttacttggaactttggttagagtcactggtcttttcatgcagttttaataaacagtttccaaaaaatttaaactttttg

SEQ ID NO: 262079 - DNA, 745 bp, Homo sapiens
acatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactatta

SEQ ID NO: 262080 - DNA, 1211 bp, Homo sapiens
caattgttatatagcaattaagtaggaggcagcctttattcttagatgtgatgtgttatagtatctgcaatttatactcaaatactacagcaaaatatgtaaatattatgtataagcaaaccaaatgtgacaacatattaacaattgctgaatctagatagaacataactgttcattattcttttaagttttccaaatggatagtggctgtttttaatttatcattgtgggcagaaaaagcgactgacatacctgctttttgggttataaaaagaaaaaagcattacagctatccctgagtcttcaaaactttactctcataatcttcacacccatcaaatctagagatttctttctcacattaattttcagagataggttctgactttataaatggaagtttaatctattttactggatattatctccagttaattattccaatctaaataaggagtgaaaggtaatggacagtttttacaaatttcttacacccacagggccttcctctcacatgaatgtactaaatgtatccccaatgaaaaaaataaagcaatatttattgataaaatgctgtgtgccaaatactcttttaaaggttttatcttttattagcatttcatcctcacaaaaatactattaggtggtactgttattaccattttaaaaaccaaggcacaggggcatgttttgccaaacaccacataggcagaggtggaattatgagaattatattatttatatatatcataaagataggccaaggctggtctttcccatgttcattacattaacagaatcattttccgttacagtgctatataaagtgtggtccatgtgttgacactggcccacaaattgtttgcttctggtctctgcaaaagttatagataccaagagcaagtatttagaaatgtttgcagcaatctgacagagttaactcagttaaataccataataaaaaactggggcttttattttgtatgtctgtttttttcttttcatttttctggtaatctatttatttatttatttaagagacagagtcttgctctgttgcccaagctagagtgcagtggtgcgatctcagctcactgcaacctctgccacttaggttcatgcaattttcctgcctcagcctcctgagtagctgggattacaggtgtgagccactgtgcctggcccgcattttatttatttatttagagaca

SEQ ID NO: 262081 - DNA, 744 bp, Homo sapiens
gcagctccgccggcctcggcgccccctcgcgcccccgcttgctcccgggagccgctcctctgcctctgggccgtccggttgtggcaggttatggcaaacttgccctcaatctcgttccaggccacaataaagacgaatttgtgtttctcgcgctcgtcgaacacatggggccgcacagccacccagtccgactcgagcgtctcctccagcgcgaacgacatggtggctccggcttctcgccgcggggaagggccgccggcccggcccgcccgaggactccccgctggctgcgccgcgccccccgctcaccctcgccgggcgccttcagccatcttagtgcgccggccggctctcccggctcgttcgcctgtccctccgcgccccgaccgccgagctcctttgtggcgcggatcgagagaaggacaataagcgtcccgggagcaggtagttcacatggtcacctgcggccggatctgtttacaagctccgcgctgccgcagcgcctcgcggccgcccgccgccccccgcgcgaggccgtggagctgcgtctgcggcgctccggtggtgaggcgcgggtcccgcggggtcaggccggcgctgtatgcgtcccggtcgctcgcccaggtcaagatccccgcccccgcccctggtgctgctgcagaaagcccggagccggcctgactgatgaacccgtctcctaaactctgcgcctcagcatcgccacaatgttgccattcgactgct

SEQ ID NO: 262082 - DNA, 6323 bp, Homo sapiens
cacgaggcctcgtgccgcgtccatttgaacgtctcgcacgccttcctgccattagcactcgagcccgctgctgttgcccgttcttcctccggaatacgggagggagagggaatgataagctgctgcggcccaagagtcactgtgaaggaccccgccgctgccctcgggcctcctcggcccctgcgcctccggggagcagccggggctcgccgcgcctgacgcgtcccgagttatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaattttgactttgaaggatcactttctcctgtcattgcgcccaaaaaagcaaggccttccgagactggatctgatgatgactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaagggacttaaaattggggccttatgtagatcattactatagagactacccaacgcttgtcagaactactggacaagtgtgcacaattgatccaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttcc

SEQ ID NO: 262083 - DNA, 691 bp, Homo sapiens
cacgaggcctcgtgccgcgtccatttgaacgtctcgcacgccttcctgccattagcactcgagcccgctgctgttgcccgttcttcctccggaatacgggagggagagggaatgataagctgctgcggcccaagagtcactgtgaaggaccccgccgctgccctcgggcctcctcggcccctgcgcctccggggagcagccggggctcgccgcgcctgacgcgtcccgagttatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggttccattgagtttcccattgtgtttttgaaatgtagagtgatataatctacttgtaatttaaggctactaagatgcaactgagagatcggtgtgatgccacttctagagtagagttaaggtgtggtaatttcaataaatgttgaaaataatgactttattacattgtcatagcgacttatttagataccctctataacttgtggttttatttatt

SEQ ID NO: 262084 - DNA, 6416 bp, Homo sapiens
tcaagggcacctttgcccacctgagtgaactggactgtgacaagccgcatgtggatcctgagaacttcaagctcctgggaaatgtgctggtgaccgcattggcaatccaggtgctttatagcatctcccaaggaagttagcaccttcttgccatgtgccttgactttggggttgcccatgatggaagaggcagaggacaggttgtcaaaactgtcgaagaacctctgggtccatgggtagacaaccaggagccttcccagggtttaacctccagcatcttccacattcaccatgccccacaagcttgtgataggcgtaccgagttatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaattttgactttgaaggatcactttctcctgtcattgcgcccaaaaaagcaaggccttccgagactggatctgatgatgactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaagggacttaaaattggggccttatgtagatcattactatagagactacccaacgcttgtcagaactactggacaagtgtgcacaattgatccaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttcc

SEQ ID NO: 262085 - DNA, 450 bp, Homo sapiens
atgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccatgggtgctgctcccaaaaccccaaagcaagcatggaagagcagaccaactccagaggaaatgggaagatgacgtcccctcccaggggccctgggacccaccgcacagctgagctggccggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 262086 - DNA, 311 bp, Homo sapiens
agctcacacacagagcataacacagttggctacgcaagtgaaaccgaaggcgggctgttccgggaatgctgggcagagactgttgatcgtgttctgagcttttaggaaatcagcacgaggaggcctctcctgaatagctgttagaagagaccatatcttccaggcctggtgtggtggtgcgcacctgtaatgccagcattttgagaggccgaggcgggaggatcccttgaacccaagaatttgaggctgcagtgaaccatgattatgccactgtggccctgatgacagagcaagaccctgtctctttaaaa

SEQ ID NO: 262087 - DNA, 930 bp, Homo sapiens
aaagtcctttttttcctgtttttccatgccatctctactttctacccctgttaaatatgagatgagatccgtaaatgagataaataaagaattttatcaacaagcccaacatggtgaaactttatctctacaaaaaaatagaaagattagccatgtgtggtggcatgtgcctgtcgttccagctactccagaggctgaggtgggaggattacctgagcccagggaagtcaaggctgcagtgaactgtgattacgccactgcactccagcctgggcaacacagtgagaccctgtctcaaaaaaacaataataacataaagtaaaataaaaggaagtcctagcttcctttatgaccattgaatatatgttactcaaatttatacttttggccagggagtgggagtagtggattcccaaaatcccttccagtctgaagtgtaatgattcctttttcccttgagagattacataggtttaaaatataagtctttttttaaagagtgataaaaatttgtggatcataaggaagtttataattttgtgcccatgttggagaatactagcatctgttaatattaatacagcccttttcaaccaccagcaccactattttagataaaattctgctgtgaataaaactttggattggccgggtgcggtggctcacgcctgtaatcccagcactttgggaggccaaggcaggtggatcacagggtcaggagatcgagaccatcctggctaacatggtgaaaccccatctctactaaaaaatacaaaaaattagccgggtgtggtggcgggcgcctgtagtcccagctacttgggaggctaaggcaggagaatggcatgaacttgggaggtggagcttgcagtgagccgagatcgtgccactgcactccagcctgggtgacagagcgagactccgtctcaa

SEQ ID NO: 262088 - DNA, 369 bp, Homo sapiens
aaagtcctttttttcctgtttttccatgccatctctactttctacccctgttaaatatgagatgagatccgtaaatgagataaataaagaattttatcaacaagcccaacatggtgaaactttatctctacaaaaaaatagaaagattagccatgtgtggtggcatgtgcctgtcgttccacttcagccccccaagtggctgcaactataggcgtgcaccactacacttggctaatttttgtatttttgatagagatggggcttccccatattgtccagcctggtctcaaactcctgagctcaagtaatttgcctgcctcggactcccgaagtgctgggattacaggtgtgagccactgcacctggcca

SEQ ID NO: 262089 - DNA, 144 bp, Homo sapiens
caccaacacattgagaggatccttgctggaaaggaacaggctgttcctaagccaaaatctggtgcttctcagaagaaaaagataacccaaaaggaactgaagaggaaaatttagggcaggaaatacaaagcacacaattaatgt

SEQ ID NO: 262090 - DNA, 970 bp, Homo sapiens
gaaaaaaagagcgctatggaccttgactagcagagtaatttcccctgttctgttgttcactttctcataaatgttcattagtaggtaaaaattgcaggggatgatataaactgatgcatctgttttgcaataacatatctaatcttctgctccaggagacgttcacagaatttgacagcaaaacctaatacatattcataaccaatatgctttgtaaccaagggaaattgaggcaagtacaacagaatgaagcatgagaaaccagcatgttaattttaaatttaattatagttataggggaaaaggctgcattttgatagtgtatactcattcagctgtcatggaacattaaagaaaaatcatgccaaatgtctgacaaaagaaatatcaattttggtgaagtggttgataaaactagcaggttatgaagaaaataaaattttgagattcaattatgagcaatttttcatgtagagaaaaaagcattgcaggattctaatgatctgaaataaaatcagacaacttcaaaattatggaaagttatctagtccatacaagataccttttaatggaatgtttcagcatgcttaaaggctatattccatttaaaattaggaaaaacaagttaatgtgatgcttattactttcttattactttcaataacctaaaaacatgtgttattagtaaccagcacacctagtctctacactgaagtgtacatattcaaagagcattgatcttgttgtcttgttcaaagtaattggtaaagaggaagtcaaactgttgctgtttgctgatgatatgactctatacctagaaaacactaaaggctactccaaaaagctcctggaactgataaaagaattcagcaaatttccagatacaaaattaatcagtagcacttctatacaccaaaagcaaccaagcagagaatcaaatcaagaacttaactccttttacaataactgc

SEQ ID NO: 262091 - DNA, 684 bp, Homo sapiens
cagacaaccagataacaaatgggaattacgtgtccattagggaggaaaaattattcagaaaactttaaaagttatgcaataatggttttcctcaagtgtttaagagaacataataattatattactctgaaacaaatgcattataccatgttttttttctcctcagataattaaataacttctgtcaatccccttactcaggtggttactgactccctaattgtgaatacatttctctctggctaataaccaacctactgtgtctggaatttattccttccagtgggttcctggtcttgctgacttcaagaatgaagctgtggacccttgcggtgagtgttacagttcataaagatgttgtgtccggagtttgttccttcagatgttcagatgtgtctggagtttcttccttctcgtgggttcgtgatcttgctgacttcaggagtggaactgcagacgtttgcagtgagtgttacagctcttaaaggtggcgtgtccagagttgtttgttcctcctggggggttcgtggtctcactgacttcaggagtgaagtcacagaccttctcagtgtcacagctcataaaggtagtgtggacccaaagagtgagcagcagcaagaattattgtgaagagagaaagaacaaagcttccactgcatggaaggggacccgagcaggttgctt

SEQ ID NO: 262092 - DNA, 301 bp, Homo sapiens
gctatggtctgaatatttgtgttcccccaaaattcttatgttgaaatcttcactacgaaggggatggaattaggaggtggggcatttgggaggtgattgggtcatgagagtggaaccctcgtgaatggtattagtgcctttataaaagaaactagagagacacccctcactccttctaccatggacacagaaagaagatgccagctatgaatcagaaagtgggccctcaccagacaccaaatctgtcttgatcttggactttttagcttccagaactgtgagaaatacatttctgcaattt

SEQ ID NO: 262093 - DNA, 434 bp, Homo sapiens
tggcagcccgttctgctcccgaatgccccggcttagtcagtctgggatgcggccctggacaccgggctttatgcagctctgaagtgatcccagcacacagcccgggtcaagctcagcgctcggcaaccataggcacccaacaacgggctgcagccatcagtaacaacggcagctccaacgcccagagaactcacggagcagacacacatcagatgaagacgcggaggcctgagcgctgggggtcgcccggggctgcacagcgggtcagaggccaaccctgggcggagccaggccacaccctccctcaaggattcacagtctccccaaagtaaccgcaacgagggaccctcccgtcaccaaacttcctttcagtcacttccgcttgtactaattctggcccaaccgttcattatatttttacaattcttaaaaaa

SEQ ID NO: 262094 - DNA, 104 bp, Homo sapiens
tttaggcaaatctcttaaaagctgggttataactttcaaacttataagcaggaaaaacgaagaaaaaaattaaactaaaggaagagaataaaggagaaaaaaac

SEQ ID NO: 262095 - DNA, 677 bp, Homo sapiens
aagagattcaaagtgcaggtgccatgaatgcctctttaatagctccatgtcgattgattttctgggctacacttcccagcattcaaattgctaaatgcatataaactactagtgaatatttattacctggatttgtgcttttgagtgatcttatgtatagttatgtgcttcagtgatccaacttggggtgcactccaaactttgataaattaaagaccctgcttattccttgagtaatgctacactgacaactgatttagtgaatgccactgtgaaaataataaacctcttggtgaatatatttagacatgtcttggaacctgtacacatcttaaccagggatgttacttggtctttctatgttcaggagtgtgtggagatagaaaatcatacaggattgtaattgttgcctgtgagactaacagaaaattcaagctagtgaagtacgcttatgcatggcacacttctcgccagcaattttaggaagttctacccacaacccatatgtcttttgatatgtgggttaccttggagagagaaaaagaaactctgaacacaagcatgaaatactttagaattttatctagagttggacttgtccgaaagcttttgtataaacttgcttgatgagcaactgttgtccactggtaccttcactgtacaatccacacacaaca

SEQ ID NO: 262096 - DNA, 425 bp, Homo sapiens
tattgactctctaaatgctatgtaatgaatcaactttatttttcttctttttttctgaagggtgtgaaaaatgtaagtcatagactatgttggcaggcctgaacatgggaagatagaaaattgaccgccatctacatacgacataattttctgcttcagcctgagatcccaagaaccactccccttcctatgccatgtagtaaaactcacatcacctcttttagttcatttaaaaggccttcctgtctgcataaagatgatttagtgtgtagcaaatcctgagattgttttaaagcactgtttaaagttcaaactcaacagctggattttttttccctctgctttgaagagagtcactatagttggaacaacttattcacgctagctctttgaaacacctgtgttccaggtgaagccaaaaaaaa

SEQ ID NO: 262097 - DNA, 688 bp, Homo sapiens
gagtttccaggatttttcacttagaagagtgaagattagaatttcagagcaccttctcttcagagtaaacaggcagggaattccctgggatgagactcttaaaatctataaccaagctcctcagatttaccttcaggcccattgcaagccttaatgtttcctgatacattgttatgaccctgccatttctatagcatctttcctgttctgaatccttaaccctctgattatttgtgtccttcatttgactctgatcacatatcaccctatttggagttgcttgggggcttgcacgcaaccaccacacactccttaacctggaagttaggtttctgctttgttgaaacagttctccaagtggtcaccaactccaaagacctgctctgagtctttactctcctccatttacctagggcaggcatttttagccttttaggatatgaccagaatgcagatatgcacatatataccatattacctacaatttgatcatctgttttttttaatcctttctcttaaaagtataaggaacaggtttttatttttttaattatttttatttttatttttatttttgagagggagtctcgctctgtcgcccaggctgcagtgcaatggcaccatctcggctcactgcaagctccgcctcccgggttcatgccattctcctgcctcagcctcccgagta

SEQ ID NO: 262098 - DNA, 239 bp, Homo sapiens
accaaagatggtggtaacaaagccactatgcagaagtttcaggaaggcaatttttggtttaaaaaaagaaagaactatctacaagtctaactgcccccaaaaagatactgggatgcctagaaagtggtgaattcacagtcactagaggttaagtatcagggaccctaaaagaattcctatatttgtgacgtcatactaaataatatccacagttcaaatcaattctaagattctatggt

SEQ ID NO: 262099 - DNA, 456 bp, Homo sapiens
caaaccagtttggagggtaactttgcagtgcagaaagttgaagatgtgcatgactcagtatatactcccaagtacatgatctagaactgcactgttcaatgcagtagccactggccatttgtggctattaaattaaaatgtattaaaattaaattacattcagttctccatttgcatgagccacatttcaagagctcagtagctactctgtgactagtgactactctattgggcagcacaatgaacatttctataattgtaaaatgttctattcaacagaagtgatatagaagaattctcatacacatggacaagaagatgtttataacagctttatttgtaataacagaatactggaaaccattcaaatgttaatacagtcattgataaacaaaatgtggtatgtttatttggaatactcgaatgaaaataaataaaactacatataccaacaag

SEQ ID NO: 262100 - DNA, 333 bp, Homo sapiens
aaatgtgactccagtgttggaggtggggctagtgggaggtacttgggtcatggcggtggatccttcatgaatggctttgtgctgtcctcccagtaatgagtgagttcccactctatgagttcacatgagatctggtggtttaaaagagcctcgcacatcctccctttctcttgttccctcttgccatgtgatacacaagatccccttttgccttccaccatgattgtaagcttcctgaggactcacgcaaagccaagcaggttgttggtgccatgctcgtacagcccacagaattgtgagccaaataaaccatttttctttatgaattaccca

SEQ ID NO: 262101 - DNA, 492 bp, Homo sapiens
cacctggctcagagacagagggaaacagttgggctgggcagccaggctggagccaccagccctcaacttccaccagcatttctgatcctcgctaggttccaggaaacaggcaggtattaacagtagccaattcagcagagaacaaatacctactcatggaaacacagaccagggaggaactgcaagaaataatcccagaggccactgtgcaaccccttggctttacagaaggggaccccgagcctcacgaggctgtgacagcttggccgcccagtccacctgttcttacttgtaagacaacaatctgcagacacatcaattccttcctaccttctcatatttcaaagagactagaacttgaaagggaaaaagtgggaagtaaaaagaaagtggatttgctccattatttattcattaatctatttctgaagcataaaccgtgagccatgcccgccctgaaataatatagtggtgaataaagaatgttaaaga

SEQ ID NO: 262102 - DNA, 312 bp, Homo sapiens
tcttacacagatagcaaatacacagctccttagtttgagcatttagggcctcctgccagtaagttcatgttcttgtcatgcagacctctgtgcaactgctgtttctgtgttgcccttagggtcctgagggccttgcctagaataatcctcatataattcctccgacaggaaagctgtgctttcttccatggctgcattctaaataacaaaggcatgatactatacatagagtaggaatttggacaccaaatcgggattctgtgtccctgtcttattcgacaaaagtgcacattactggggagatgggggcgg

SEQ ID NO: 262103 - DNA, 501 bp, Homo sapiens
ctatacttttcacttttttcatagaatccaagacaagaagaatctttcaagtgttgctaaccagaactgagcagatccaagtagcaatcgtagccaagccattagtccatgtatggagagaccagagagggcatccccacgtggtgatgcctcaagcttcaggagcactcgaccagagtcagtgtagcccttggcagctggtgaagcacaacctgggacaaatggaagctttagcaatgagccgataggtcaaggctaaccagaaagaatgcagctgggtaatgcaagctatcctatcttgtaattaaaagggttttctgtgcggttacctgacgtagttactaaatggcttgcatgaaataacatgcagcattctgcagttactgtgcaattaccttatatcatcaccctacagtcaaaagacaaaaagaaaattcagggtgaagcttttaaccgcaatttgtagcaaagatgtttggaataaaaacacattgcttgtta

SEQ ID NO: 262104 - DNA, 352 bp, Homo sapiens
tcctcctgaggtaatctcatatgtgaggcggaaatgaactggatacacacaggaaccaccgcgcgtctttgcatccaattattcttaaacaattgccccttctccttcggagcatcccttctaccaaccaggatctattgtctcagcacctactttgtgctcagatctttgccaggttctttgggggatacaagaccacggaaagccaggtacctgcgcgtgaacctagtgagactggtgcgttaatggaaggaagggagggcgcccattaaaattacttctcgtgctgcacttttttgtggaatgaaccaaaggcatccggagaagaatatagtattgcacgcctggactt

SEQ ID NO: 262105 - DNA, 366 bp, Homo sapiens
atgcctcaataaagcaacctaagaaaccctgcctgagtttccagcctgctggcccatcctgcagatttagaactgaaaactacatcaactaatttgcctgcattcccactttaccggccagccctacagctttcaaacttgccagcccctacagtcattactggcaacaaggaggtgaaatgtacaagtaaccatcgtagcagaactcagtctttaaaaaaggtttcagtggacctaagaaaaggaagttttaagagagaccatgggaagactgcacattcttgacaacccatccacctatcctgagaaagacattctgtacctattccaccttcagaaaataaacactgtcaattgtggctttta

SEQ ID NO: 262106 - DNA, 317 bp, Homo sapiens
agagcaatctctttgctcaggcttggatactgaacccatgcctggtaaaggctgtttctctgcagggataacaacaacacggaacatggaggttggccaagttcttttttcagctcattttcagcacactctcaattccctcctttgttgattcttacggtttttgtgtacaagtttacttttaatttgggtaccatatcataattcatctgtgaggcccctttaacctatgcacccacaaacacaagcaatgtttaaataaagaaagtaacaggccggatgtgatggctcacacctataatcccagaactttggga

SEQ ID NO: 262107 - DNA, 475 bp, Homo sapiens
gaaggttcaggggatccccaggctggaaggagcctggtttctaaataggacaccgatgccgaccatctttttcaagttaaactttggaaagttccatttgccatgcaaactacccttgccctggatgggttgccccaagagtgacccaggaaagtttaggtggtaaagttgcaaaatcaagtggcttcagggcccaggcagagatttcactttcagtgccctgggatgaaatctctggatgtccacgaggctgacctggacttcccggattgggaggccttgtggtcaaaagccgagtccagtcctgaacaccagatctaaatgttcaagaagactgtgcagatttacaggctaaatcagagtccctggtagctgtttccgacctctgtatggggcttttagagtgaactgtggtctcatccaggcgtttcccgaccattgcatcccacacagggcctcccttctgattttatcg

SEQ ID NO: 262108 - DNA, 387 bp, Homo sapiens
tttcctttttaaaaatgtctctttgggccctttgcccattttttacttgtttgttttcttgctccttaattgagttccttatatattttggacattaactattcatcagatgtatggtgatatggtttagctgtgtcctcacccaaatctcatcttgaattgtagctctcataattcccatgtgttgtaggagggacctggtgggagataattgaatcatggggttggtttccccatactgttctcatggcagtgaataattctcacgagatctgatgattttaaagggggtttcccctttcacttggctctcgttccttctcttgcctgctgccatgtaagacatgacttagctcctcatttgccttccaccgtaattgtgaggcc

SEQ ID NO: 262109 - DNA, 178 bp, Homo sapiens
actcattcaatcccttttccaacaatggagcttttagtcatcccaggtactgctgtacctgtacataaaacgggaatggccatttgcttctttcttatgtaggaactcatgctgtataaggactactctcctttccaaaacatccagtgtgtctgtatctaaggaaggcatcatggcc

SEQ ID NO: 262110 - DNA, 675 bp, Homo sapiens
ggcaaatcataaaccagaagtttaaagaaatagacatgaaaaggtccagaggatttaactttatagatgcaacatcttctaaagtcaaagattagataatatcgtgaatattgagccttggggcattcagtgtctactctaggtcttcaaaccaaaagcagtccacgtcaacagagtttacacaatgaggaaaagtttattcttaaaaacaagcatgacccaagaaattatttagctttttatctaatcccaaaatgaacttcacaaagctttagaacacggttttgctgtttaacatattgttgttttcagtaaggtccaccttatgaaagctgtgactcctttgaggtggtcaaattaaaattttgcagaaagcttacaaattatcacatgcaaagtgaggtacttaaaagggtcaactacataattaacttcacttccaactcagtcatacatgctaatgagatcttgggacaggatgaataaatgcaattttcagttaatcccaaaccacatcatgactatcaattgcaattttaaaaattactaagcattcttcaaaaacactgttctgaaagaatattagaaagatctgactcagctcccctggctagcctctcagtggaggtgctaatgagcagtgaaatggctaagaagggtctagaaagataaaat

SEQ ID NO: 262111 - DNA, 1239 bp, Homo sapiens
ccatgactatctttattcacactcttctctgagcctgaaatgctccactcctcctttccaacctcccaccctcacccctaccccattccctcctcacgccccctgccccctgccccgtgttcatgccctgtgctggctctgcctccacacctgcctgctgcctcccacagagcccgcaaggcaggaacccagaccctggcctcagcacaagctccagtgcagaccccagcacccactctgcctggtcctgctcttccagggcccttccctggtggccgtgtggtcaggctgcacccagtccttttggcctccactgtggacagctatgagagacgcaacaagggtgctgcccgagttatcgggaccctgttgggaactgtcaacaaacactctgtggaggtcaccaattgcttttcagtgtcatacaatgagtcagatgaagtggttgttgacatggaatttgctaagaacatgtatgaactgcataaaaaagtttctccaaatgagctcatcttggggtggtacgctgccggccatgacatcacagagcactctgtgctgatccatgagtactacagccgagaggcccccaaccccatccacctcactgtggacacaagtctccagaacggccatatgagcatcaaagcctatgtcagcactttaatgggtgtccctgggaggaccgtgggagtgttcacacctttgacagtgaaatatgcatactatgacactgaatgcatcagagttgacctgatcatgaagacctgctttagccccaacagagtggttggactctcaagtgacctgcagcaagtaggaggggcatcagctcacatccaggatgccctgagcatagtgttgcaatatgcagaggatatactatctgcaaaggtgtcagctgacaatacaatcaggaaggtgggccacttcctgatgagcctggttaaccaagtaccgaaaatagttcccgatgactttgagaccatgctccacagcaacatcaatgacctgttgatggtggcctacctggccaacctcacacagtcacagattgccctcaatgaaaaacgtgtaaacctgtgaagccaccccaagcagtacgcttgctggtctaagtcttaaccccaggactcagaagtgaaggaaaaatgggttttttgtggtcttgagtcacactgagacagtcaactgtgtgtgactctaataaacgtagcctaccttttgtaaattaaagaa

SEQ ID NO: 262112 - DNA, 5751 bp, Homo sapiens
  misc_feature (1857)..(1857): n is a, c, g, or t
  misc_feature (1887)..(1887): n is a, c, g, or t
  misc_feature (2054)..(2054): n is a, c, g, or t
gcacagccacagcctcctcgcctccccaaactcccagccaaggcgcgcggtggcgtcctcgcgccctcgctcgcgtccccgcccgccgcctgcgcaagccaggcatgaatgctgagacttgcgtctcttactgcgagtcgccggccgctgccatggacgcctactacagcccggtgtcgcagagtcgggagggctcgtcgccttttagggcatttcccggaggcgacaagttcggcacaactttcctgtcggccgccgccaaagcacagggattcggggacgccaagagccgggcccgttacggcgctgggcagcaggacctggcgacacccctggagagtggagctggggcgcggggctcctttaacaagttccagccccagccgtcgaccccgcagccccagccgccgccgcagccgcagccgcagcagcagcagccgcagccccagccgcccgcgcaaccgcatctttacttgcagcgaggcgcctgcaagacgcccccggacggcagcctcaaactccaggaaggcagcagcggccacagcgcggccttgcaggttccctgctacgctaaagagagctccctgggtgagccagagttaccccctgactctgacactgtggggatggacagcagctacctgagtgtcaaggaggctggggtgaaggggccccaggaccgggccagctcagacctccccagcccattggagaaggccgactcagagagcaacaagggcaagaagcggcggaaccggaccaccttcaccagctaccagctggaggagctggagaaggtcttccagaagacccactacccagacgtgtatgcgcgggaacagctggccatgaggacagacctcactgaggcccgcgtgcaggtctggttccagaaccgaagggccaagtggaggaagcgggagcgttttgggcagatgcagcaggttcgaacccacttctccactgcatatgagctgcccctcctcacccgagctgagaactacgcccagattcagaacccgtcctggctcggcaacaacggggctgcctcaccagtgccagcctgcgtggtcccctgcgacccggtgcctgcctgcatgtcccctcatgcccacccccctggctctggggccagcagcgtcaccgacttcctgagtgtgtctggggctggcagtcacgtgggccagacgcacatgggcagcctgtttggagcagccagcctcagcccaggcctcaatggctacgagctcaacggcgagccggaccgcaagacctcgagcatcgcggccctccgcatgaaggccaaggagcacagtgcggccatttcctgggccacatgacagggcacccctgccccgtccccacctcgggacaccatgggccacgcccatgttttccaggcccccagcctcccactcgactttcctcttaggaacctggcctgggccaggggcctgaccctcagcactttcagccgccccaagtctgaggccccgtggactgctgggagggagggggcagcaggcccctggcccctccctggcactgaggccctgacccctgctcccggccacaggcagtggagaaagccaggtggccacgtttttcagcttcgcatccatgataagctgaaagcgctttcttgctcccgcccactcctctgctctgcctagttgaccatgagtcaatgctagatttccatgcagacccagcagcctcaccagcccagtcttgtccatccttcccgctcctagtggggtcccctggtcaccaggccggtggctgtgtgtctgaagcacaggctgccctgcagagccagcctcctgccctcccatctttctctccctgaaagcacanggaatccgacctgctggggccaaggcgccngcctccacctccccccgaacagtgacgagtctgacagagcctggctgactgcatcctggctgtcccctaggctggatacacctggagagagtgggcagaggatgacaggagctggagccgaggacccctgctgccatctagcaatgccagtccccaggggagacacnggccagcccctcactggacactataggggaggagccagacctgagggaggctgagaacacagatgccacaagggctcccatggtgctagaagaaggaaaggtcctgggagagggggaggcatccgggtggggcgtgggcccgggcagtccccccgctctccggcctgcctggcatctggtacagcggggaggtctgggcagctttgttctccatccagagcccagtcaggttccctccaggaggatgcggaggggctcgtctcttccctgccctaccctggcccctccctggggctgctcagcagtgtcccggcatggaaggactcacaacttcggaacacataagctagagcttgggggccgggtggcagagggtcaaaagctgcgtgcaggctttgctagaggacgtgtggccatgctcggcctccaggccctgctatggcctcaaactgactgtcctccctgccatatctgtcagtgtcatcgctgcccagagccttccacggcagatgggggctctgtgtccctccaggcactaggaggtgttgctcttctccacacagctttccacactccgtccttacacttcttccacagggaccaggactctctgccctctctccagcctgcggaagggctcctggcctgggctcctcggtgtggctttgctattgcaaatggggctgtcaggatgccctcctgaaaccaggcttcctgcctccaggaagcggggctctgtgcctgcctgcccgacccatgtagcttgggtctggccctgagccccagccctcacctcagctgggagtacacagtaaccgtccagaggcaggcctgtcagaccccaggtggggggtccctccagcaggcagcgccccgcattgaagcgctcgccttttctaccttctcccttgattcctgtcatggagtagggccaggcccactatgctcagggtcgtggacacagaaaggcctcctgggttgggcggagggtaaacttggtgttgttgaatgagggtctctggggttgggggtgacagtctcccgcctgcctggtgttctcatctgctctagaaaccaggctgaggaagggtctggctgtggcctcccttaatgagtcagacctctttgtgaaccgtagctctaaaatggatcttatagaggtgaaagggtcttggacattgaattaaatgttcttggaggcttggctttaagtgtttcaaatatttgaggatttggagtgacttttgggaagtttttttctagttctgaggttcgctgaaatgacccagactcccccaaaatctagccagggaaaggaagaacttaaggctgggaacagtttccccatttctcccccctttccttctgaaatgctcatggctgaggaaggatgggggaggaaggaactttcaccttgggtctttctcacccatgagagaatcaggacaaagaggaggagagccaggtagctccagagtgggccaggagggagagcaagggaatcaggacaaagaggaggacagacaggtagctccagagcaggcagggagggagagtgagagctttaagggggctcttccgcagtggcccccggcactcagttcctccatgcgtctgctctctggctgggctagacccaagtcaggcaaatttcaacccaaaagcttgagaagaaaaggcgtctattagaagactctgtggctatggctgcctgtcccaacacacccaggaagtgtctaggattaaacatgccaatgtgaaacattcctgttcatctcgtcaaaggcagccacgtaccccaggcctgtcctctgtggcttggcccagcccttgggggccacctaaccacactaagtatgataggaccaccgagttgggaggaagcttagaaaccctctagttagtccagtcccttcacaacagagaagaccctggcccagagtggagacatgactgccctgacctgtatttgccctgagactaggctgagagaggagcctgggacgtgccacccagggtgtgagggcctgggcttcgttggcaccaggggcggccggtgctgcatggagctcccctctccaatgcctcatgggcattcactcagcagctcagttctccagaagagaaccttggggcccagtcccttccaagacaggtggctaggcccaaccttctgcactgcagagcagggggccactgccgtgtcagctcctaggatgactgagcaagtcagggcagctgcccaaggccatctggagctaaagctcatgaaggcaggtggagagaagcatctacctgccacgtggttcattgctatgcgaataagctaagagaggtgaggatttcctttggatacctgcctaagatctcaacagagatggcaacttaaaaatgaagtcgtgggtagccggcagatggatgggcagcctccccacactgacagcctccagtccctgctgggcacaggtctcagcatggcaaggcttgacactaaggtgctgctactgccctccagatgccagcactactcctggggcatgggagcgagggctctggggggcacacagagaggcttgtctccaaggctgaaatagcacttggaggacatgggcttttagaactttccttgaattcttttaactatacttgattctcagcgctcactaccgtgcctccagcttcgggaagcacggtggccaggttagctcaaagacactgcgatggggtaggtgcagcaagtgtggggtgggtccccagcacacacagctgtgatcacactggacccagctccgtgccccatctcctgtcatttcggctgggcagacgagggacgcttccatgaaaactacgtaccctgcttatgcagtcattccctccctgggctagacagtggggggccatcttcgagaacctgaaagacacgcgggggttcctggtctgtttcatggcccttactgtccagtgcaaaggcaaacaggcctagctgggggaggatggttggtaaactggcccccaggataatactctgtgactatccagttaaaaaataagaaggtgacaatgacccatcaaccccacttcacttctttcaggatgctgtagggaggaaaggtgcttccatgacctaacctcggcctctcctttcttccctcttcactcacacacatagagctaggcctttatactactgattttgaaggacagttttcaatgtctaatcatctgtttaggtgtgcagtggttgaaaaaagaaagctgagtgctagaaggaacatgaacctcaaccgttacttattgttctcattgtaagatattttaaccctgtataaatgcaacttttcctttagcttaatggcctggggtggaatattaaaaatatatattaaaaatacagtaaaaatccagaaaaatgtaaaaaaaaaaatgaggtcggttccataaagttttactgcctataccaccatgtaactacattatagcaaaatattaaaagaaacgttcttgccttttaaagtaagttattgcacttacatcttttttgggagaggaggaacacggatgggaaggagacgtaggggcccaggcatggggcaaaatggagtgcagaggtagccgggcactcccagaacaccctttgctggcccagcccaaactgtttggttgttgttatttgcaataaactccttctccttcctcc

SEQ ID NO: 262113 - DNA, 186 bp, Homo sapiens
aagataataggttttttttttaaagaaaagcttggtatccacaacacagaattgtagcaagatccaccagaacatgaagaacactgaagcatattaataaaatctacatctattatgcatccttagcataagatgtgtacttatctcatgatgcaaaacagaagtagagtgtttatatgttaatta

SEQ ID NO: 262114 - DNA, 368 bp, Homo sapiens
atttcttccccctctaattcttataaaaaaactcagtgatctctgtgcatcaaatattaaactgaagctcaacagatcatgattctggcttgtctctctctccagcctgtgggttaacaggtttgcaacatttgcagagaagacaccaaattctcaggagggcagagtttccaaaggtactggtcactcttgctctctttctcctgctcaaaattcagcactagagagtgttacaccattgcacctgcagaggagttcatctgactctagggactacagaggagagagatggacaaactaacaggcattcagaaaatgactaccacaatggggaagaaaatgaaagtcaaaccaaataagcaatggtc

SEQ ID NO: 262115 - DNA, 420 bp, Homo sapiens
ttgtcctcccaagggggacaagacttctccatgtccttccttcccactgggctggtttccaacccaccaccttcatgattcgtgaatgcaaagagaagaccacttagatcggtatgttttgcttccacttggcagccctaggtgctggaggctgcagctctgggtgaaggtgggccctggtctgtggggtatgggcatctgtgagcaccatctgcatgcagccccggaggtcaggtggcagagtctcccatgacaggttccagcagcagaagtcctaaggaagcagcttgtgtctcagatgaggctgtgtacctccgttgcctgtctaggctggaggaagggtgatggcacctttaactggtcccttccttacagatcactaagtgtaagaggccaagcctgcaaagaaaaaaagggaga

SEQ ID NO: 262116 - DNA, 517 bp, Homo sapiens
gcagtcttggtggctcaaatgatgggaataatgttggcattggcacctggattttcctagatggtgaacaactctttatgatttcctttccattttcatagaaattgaatttctaaaaaattaagtgtttgcaaaaataagatgtgtttatatgtgaaacagtttaggttctaggctcagaaaataataagcagattttttggggggcgaggggtaatttgattttattgcattaatatatagtaagcttattttcaaaatatcattcttcaggatcatgatttttcttataaactgtctaacaaactttgcccactttttattatcttgttttttccaatgcaaaagtaatgccttttgacaaaagtgaatgagcagtagaagttcccctccaacacctaaactcaaaacaaaataggaatctttaactgagttgagagaagttctgtgacttgtgactcccagccaatatggcattggtaataattagtaataaaatgaggtatatttgtctata

SEQ ID NO: 262117 - DNA, 683 bp, Homo sapiens
ccctggtctcttattctgtgattataaggatactaacctcatctaaacctaattaacttccaaagccccatctccaaataccatcatgttgggggttaaggcttcatttcgaggaggacacaaaccttcatttcatatactggacattgtgtgaaaaactgtagaagctacagagaagattcactctatcttctagcaggcagatggagtagaatcagaatatatccctccaaacaagaacttcatgaggaagaggatgaggtttagaattttcaaagtctagactcagctttgttctggtttccccaaactttgtgttatacgccaagagggacccaactaagggcctgacatgtttatcagggactctccttccttatgggctctcaaatctaatttttgtgtctgtaacaacttaaaggtgccagcagctccagtcagcttttcagctccttgtttgtttaggttcatagccttttaccttgtaaggcttaagaactgcaaaggtctcaaggaaaactatctcaaagagctgggctaactcctgggttcctctcttctctcgtcaggatctcaatccctcaattcgtagctatcttaatagatatacaccctaactttttgtctccctagctatttgacagtgcagaaagctctaccagcttctgttggtggcagcgtct

SEQ ID NO: 262118 - DNA, 641 bp, Homo sapiens
aaacagcccaggtatccatcagtagctgaatggatcaacaaatgatgatatatttacaccatggaatactaatcagcaataaaaaagcaaactacctttacacacaaacatgggtgagtctccaaaacatcatgttgagcaaaagaaaccccagggcaacatttataagatgatgaaaatgttctgtatcttgatttggatggtagtttcctgggtacataatttgtcaaacttcatcaacatgtaaatgtaagatccgtgcattttactatatttaaactatacctcttcaaaatttttaaaaatagtaatttgcaaataaaggagagatccaccacctgtctgtaatcaactgagtttctaggtagtttctagctcaattgtctgcagtggcggaaacatattacccttaaattatgggaaacttcaaagggacaaggtcctcttcaaagcaaataattctcattttccactgggctagctgatctttgtggagaccactctatcagaaaaagtatgtatgctgatgcactgatgtggggacagaggtttcagccagggcaacttggattgtggtcagcccagctagaaggaagccactggactgtcatagtggtctccaagaacaaaacaacttcctt

SEQ ID NO: 262119 - DNA, 693 bp, Homo sapiens
caacatagtctgaagacttttccactgacatgactttgctttaattgttaccctcacccaaggaactttcccagcaaaaaatctgccatcaaattctactcatccctgaagacctgtttaaatggcattgtctccattaaatcttctaccagagcctagtctgatgcttcatacctagtatgggctcagaatatatctggcgaaaagaattcagtcacttaggattggaacacttaatggtaagttaatagaaattgtacatgagaaattagtccaaaggtagatgaacacttaacttttactctatgaatacgaggtaaagaatgtattattcagggttccccagagaaacagaaccaatatataaagagattttattttaaagtattatctcacacaatgatagaggtggagaaatcccacaatctaagagatgcaggaaagacagtggtgttttttgaaggaaggcctgaaagctggagggccatggtatagaatccaacgtgggcctgaaggctgagaactaggagtgctgagaggagtagatccattccaagctcaaggagtcaggcagagagcaaattcaaacttcctctgcctttttgttctattcaggccctgaatggttttgataatgcccacccacactgggagagaacatctgctttactcagtccactgattcaaacacca

SEQ ID NO: 262120 - DNA, 388 bp, Homo sapiens
ttgcttgatgtcgcccactttcggagggagaaagcgaatgcaagccaaaagcttacaccagaatccccacccctcccccacccctcatggcccccaaacaaaagaattttccgctcctttcggagtccgctggagcagtttctgtgatttcttgcacgaaccaaatgcccgaggcttagcaaagcaaaaacccccttgaaggaaaaaaataaatacttaccactagtcgaatttctaatgagccaagactacaaagataaggtgtttaagagaaacagttgtagaaacagcttaatacattgacctaattagggtaattattttctgctgtttttattcatatgctgacaccttttggaggcaagaatagcttgaggcagccaagaat

SEQ ID NO: 262121 - DNA, 1073 bp, Homo sapiens
tgtagactgcttggttttatgtgttttaattaaatgtcatttccttgaattcattttaaggcttcttgcaagaatccttttcccagtacaattataatgacgaattggggctgagctcactaaaatattcaaatatatgtcctatatatgatagatttttcctatcaagttaaacaattccagggaagccactatttcttaggtacttgttcaaggtcacgatcatgcagcagtaaacaatgttcctgcatggagcttagattctagtggacacagattttgtcatgtccctcattatacttttgctaaattctgaccttacttatcattttgaaggcttcactcctgcatattgcttattggatgtgaaggttctgattgaaacatattgtatcattctttatagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtggattttctgaggaaaatgggaagtctaagtcttgaagagcacccctatcacactcatcatgattaatagattcatcaccatcatggactctctgatgaatctgaagacaacgaactcttactaaagcccttaccacacacaaaacatttgtatggtttctctccagtatggactctctgatgggcttgaagatgtgaagtctgactgaagctcttaccacacatgccacatttatagggtttctctcccgtgtggatcctctgatgaacatgaagatatgagttccagatgaagcctttcctacattcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctc

SEQ ID NO: 262122 - DNA, 3182 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccacgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaaaccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaagcccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaata

SEQ ID NO: 262123 - DNA, 1382 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagaaacctgaatagagtcaccttgtaataactgggaactcttcccctgaagacacctggttaattcacttgcaacctgtttccagatttgccagcaggacagctcttgatttgaaagggttttgcaactgcagcactactattttggactggccaattctctgttgggggcactgtcctgtgcactgtaggagattttgcagaattcctggatactacccacaaaatgccaatagcacccctctgtcaggtgtgacaaccatttccagacattgccaaatatcttctgggggcgaaatcacccatggttgagaaccagcaatttaaaaggacagaattttgcctgagcagaaagaccagaaaaacctatcctgttttcccagggattagaaaaccttttgtcttcaagagcaaagaaccattttaaaaggtccaaacccttaaacacctgagagcaaagagattctcaagggaactgaagttcagggtcagagagtgcctgtcctcacccactgcaaccaggttcttgaagttctccaccatgacatctcggtacagcttcctctgggtaagatcgagcagtcgcagttcctccctggagaagaccacagccacatccttgaatgtcacagcctcctacaatatcaaacacatgtaacctcaatcttacaaccaaccttcactagaagaagggtggcatcaagaaggaaaagagcaccacaaaaaagttgttatagattccaagagatctcagtcaattttcagctgttacagttttccctgtctcactatctcctacgctcatccccataaagcctgtagtttatcactgttttttgtttttttcttttttgagatggagtctcactctgtcacccctccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatcttta

SEQ ID NO: 262124 - DNA, 236 bp, Homo sapiens
gctcgactgtcacccaggctggagtgcagtggcgcaatcttggctcactgcaacctccgcttctccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatcttta

SEQ ID NO: 262125 - DNA, 1000 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtggattttctgaggaaaatgggaagtctaagtcttgaagagcacccctatcacactcatcatgattaatagattcatcaccatcatggactctctgatgaatctgaagacaacgaactcttactaaagcccttaccacacacaaaacatttgtatggtttctctccagtatggactctctgatgggcttgaagatgtgaagtctgactgaagctcttaccacacatgccacatttatagggtttctctcccgtgtggatcctctgatgaacatgaagatatgagttccagatgaagcctttcctacattcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctc

SEQ ID NO: 262126 - DNA, 1425 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagaaacctgaatagagtcaccttgtaataactgggaactcttcccctgaagacacctggttaattcacttgcaacctgtttccagatttgccagcaggacagctcttgatttgaaagggttttgcaactgcagcactactattttggactggccaattctctgttgggggcactgtcctgtgcactgtaggagattttgcagaattcctggatactacccacaaaatgccaatagcacccctctgtcaggtgtgacaaccatttccagacattgccaaatatcttctgggggcgaaatcacccatggttgagaaccagcaatttaaaaggacagaattttgcctgagcagaaagaccagaaaaacctatcctgttttcccagggattagaaaaccttttgtcttcaagagcaaagaaccattttaaaaggtccaaacccttaaacacctgagagcaaagagattctcaagggaactgaagttcagggtcagagagtgcctgtcctcacccactgcaaccaggttcttgaagttctccaccatgacatctcggtacagcttcctctgggtaagatcgagcagtcgcagttcctccctggagaagaccacagccacatccttgaatgtcacagcctcctacaatatcaaacacatgtaacctcaatcttacaaccaaccttcactagaagaagggtggcatcaagaaggaaaagagcaccacaaaaaagttgttatagattccaagagatctcagtcaattttcagctgttacagttttccctgtctcactatctcctacgctcatccccataaagcctgtagtttatcactgttttttgtttttttcttttttgagatggagtctcactctgtcacccctgggaagcggaggttgcagtgagccaagatggcgccactgcactccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatcttta

SEQ ID NO: 262127 - DNA, 722 bp, Homo sapiens
tagttataggaccttgggcaaattccttaatctctcactaactgaatttcctcttctttatcattgtatctaaattataaggtgtatgagcctgacacagaaggatcacttcagcccaggagtttgacggtgcagtgagccatgattgtgccactgcacttcagcctgggcaacagagtgagaccctgtctcaatttttaaaaataaattttcaggctaggcacaggggctcacacctgtaatgccagcactttgggaggccgaggcgggcaaatcacttgaggccaggagtttgagaccagcctggctaagatgctgaaaccccgtctctactaaaaatacaaaaaaattagccaggcgtggtgatgtgcgtctgtaatcccagctactcaggaggctgaggcaggagaatcacttgaacctgggaagcggaggttgcagtgagccaagatggcgccactgcactccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatctttatcatctcttttgtcctattttgtgactacatacaacaggattccttggaactgaagatttatctctaaccaatccaaataatgt

SEQ ID NO: 262128 - DNA, 489 bp, Homo sapiens
gtgtaggctggtgctaaaacatgacccaggtctagaaagacacacaatccacccctaactcctttcctcgtctgccactccttatccccaggattacttgttcttttatgactgcttttctccttcaaagcttctcattgctagtttttatcagatttcaggtgattaaaaaagaagggcatactatgattgctgtgttcctcaggtacattcctgtgtttctctgaccttttggatcccctaacctaactgacttggtgaacaggttctgtgatggggaagggagatggacacccttctctaggagggctggcaaaaatacaccaatcacaaatagtcatctttgttgtgctttttgtttaagattgttttcctcttttgctatggtgggtgttgttcttcggatttttttttttttttggttgatagtattttaaaaccagtctacataacaactaaaaaatgtgggaaaatagctgtagttgaaaa

SEQ ID NO: 262129 - DNA, 751 bp, Homo sapiens
tttttttttttttttttgagacagactcttgctctgtcacacaggctggagtgcagtggtgcaatcttggctcactgcaactgcaatctctgcctcctgggctcaagcaatcctcccacctcagcctcccaagtagttgagactacagacacatgccaacaagccaagctaatcatacacactgtatgatttcatttacatgacgctcaaaaacaaaaacaaaagtggacttcgtatctattcttaagtgcagggactgcggggagggccttttggtgctgactacattttctttctcggtctggcactgggaactgcgcacacacgtgttaacagttcatcaagttgcatctgcttatctgcgcatggtattgtcagtaggcttggacctcggctgaagcaaaagcttattcgtcagtgggctgcaggacctgcagtccatgcaaaggaggtcactaccagctgaaccagagtggacaactaactgttcctcctcatgaaagcttcaaattggggtactctcacattgtatgcatacatccaaactagctgatgtctcccgcccccgcctcaacaagacactcattcaaccccagggaatgtaggaggtcgggttctggatcttactatctgacaacgagaagttgtttcctcataatgcggcatggctttcttatctgaaaatgagggcaggattaacagatttacctgtgattctctggtgaatttaataaaataactagcagttttt

SEQ ID NO: 262130 - DNA, 895 bp, Homo sapiens
  misc_feature (840)..(840): n is a, c, g, or t
  misc_feature (846)..(846): n is a, c, g, or t
  misc_feature (851)..(851): n is a, c, g, or t
  misc_feature (871)..(871): n is a, c, g, or t
  misc_feature (884)..(884): n is a, c, g, or t
atgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaanaagccntgagncaggcctggggtgtccaccngggtcactggagngccagcccctc

SEQ ID NO: 262131 - DNA, 863 bp, Homo sapiens
agcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgcccattatagctgagagtggagccttagctggagcaccatgggcacggccatcttagaggaaggcagcagccgtacggcagagaagatgctcatatccaggacaatttggaaaaataaacaaggtttgaagaagtcacggtgctggccaggaagcggtcacagagttgccaaaaccagtggtcactgaaagtgttagatttggggatagggcgggggttctgggctgggtaaggcttttgtgggttagattagactctgactgaatggacgaagccgagaacaggagtgatgctccattaaatgctaatacccacatggggcttgctattaaaaccactgccagtggggaaggggatgaggaggtgaaggtgcaactgtgttaatatctacatgtttccttccagaagtaaaggaagatgacagtggggcacttaagaatatgaaattattagaatgcgatcatcctactttgcaatgtttccagattttttaaaaagtcacacttaaaaaatattagttctatttttgcagatgttggcgttgtaactgtagaagatttaagtaaatattgtatttttggaaggcaacctagagccaatttaattttttcgttttctttgacacagcaattctaaaagctatctaggcaaatctgtcttaatattaaccacaacttttgtaatttac

SEQ ID NO: 262132 - DNA, 226 bp, Homo sapiens
agggtttgtttagagccactcccaaatcctcactcccacactcatccttgcagccagtttttgaggaagaggagaacgtgtaaccccaatgcaagcttcaccctgactgagaggtagtggttcttcctgtagggaatgaatttggtttgatttggggttttcctttgaagcccaaagaacttgctgttatgattcgttaaccatattgcaataaaagctggacata

SEQ ID NO: 262133 - DNA, 445 bp, Homo sapiens
gaaacggcagccagacttgactccaatgtacacacagactcaggtttcgccccgtcacctgttggctcctgaacaacactcctctttgtgaaacttacagcacccatttgaaacaagtttccagagaaaacacttcaagaaagtgtttgagaagtcacaagactcgagttgtaaaaacaaattccacacatagcctggcttataaggacacagactaacgggaaaggccgagcttttaaaaatggggctggaggaagcgagaaggaaaggatgtcaccgtactttgggaaaactcagccggccaattcttgatggggctgccagtgatggctgcagggggtcccctgggtcgtccccatccccgccgccgcagcagcagagacgcctcagagcgggcgtcggcgccccctgggccccgcaaactctgcgctccaggcggcggccg

SEQ ID NO: 262134 - DNA, 171 bp, Homo sapiens
aaaaactgtatcaatttaccctaagaattaaaaacaaaaatcattttttgcctattaaaagggccaattaatatttcttttcatctctgaagagaatacagaatacatatagtacacattcttaaaatgttttaatttggcagtgtgtctacataattttctcatgataca

SEQ ID NO: 262135 - DNA, 739 bp, Homo sapiens
ccacctccttcatatgtgccaatcctggaaaatggcatagtgggggaagttcacaaaataaagatatttcaggaaagcctcacataattgcctggcatttgaaggtactaagctttcagtagtctcttcctatcgttcccaccccccacatcatttttctagacctctttaaagcaccttatagcctcaaattccctacctgacatttatgtgtactaacaaacatgattttccccgaaggaaataaatatggtaattttatgctttttcttcaaatcatcaaaacatataatggtttatctctagcagagtaatgctattttaatctccaggagaagactctgaatatttggttgccaagttcacctattataaatacataatcaaaattgtgttcatcatgaaaataacaatgtatagattttaaatattacataatattataagagcataatatggagaaaacgcataaaaatatcgccctttaacttcatggtaaaacatgaacactttggatttaaaaaaaaatcacaaaacatttaaataagattatcttcctattgatcaccataatatgagctcagagaaagtaacagcctaaactggcaaaactattatcatgcaactcttctgtagctaatcagtaaataaagatagaattctaaatatgaatacagaataactgtaacaccttttattttacaaaatgttgtcaatttcattttattttagaatagtt

SEQ ID NO: 262136 - DNA, 539 bp, Homo sapiens
ccacctccttcatatgtgccaatcctggaaaatggcatagtgggggaagttcacaaaataaagatatttcaggaaagcctcacataattgcctggcatttgaaggtactaagctttcagtagtctcttcctatcgttcccaccccccacatcatttttctagacctctttaaagcaccttatagcctcaaattccctacctgacatttatgtgtactaacaaacatgattttccccgaaggaaataaatatggtaattttatgctttttcttcaaatcatcaaaacatataatggtttatctctagcagagtaatgctattttaatctccaggagaagactctgaatatttggttgccaagttcacctattataaatacataatcaaaattgtgttcatcatgaaaataacaatgtatagattttaaatattacataatattataagagcataatatggagaaaacgcataaaaatatcgccctttaacttcatggtaaaacatgaacactttggatttttcactggccgtcgttttac

SEQ ID NO: 262137 - DNA, 275 bp, Homo sapiens
ttcctcttgatacaccagagtgcttcttccctattttgggtcccaggcatcgatgctctggctttagtgtgcctgagactcatctggggaacttgttaggattcctgccctccaagctggaagtgcagattcagtctggaggggggcccggaagtctgcactttcatgagcatctcagggggtgccaactccctttgataagcatctccttggacgtccatggaccccaagctaggactcccgagtaagtttccttgacattgcatatccatatg

SEQ ID NO: 262138 - DNA, 419 bp, Homo sapiens
cagcatccatcttcgaggctttatgtaaggttctacaaatatccagggatagcagaagggcccagcctcagtcaaccacgaggcttagaacccaggaaaccattcactcattaaaaaccatgccagtgagcatacctagctcttccctagggtatagcaccttggaaagcaaataccacagacttagccaacctgagtaataatggataattctaatgtctgggtttaaccactgtcatatagggttacaccttcccaagcacacctcacaattcttttttttttttttttggctacatcagttatgtctaatatatctaatactcacatcagcctccttgggaactaaacagctcatcaaagagtagtgatggagaaatgggagccatcgtattaataaaataatattaacaacacca

SEQ ID NO: 262139 - DNA, 139 bp, Homo sapiens
gaaacggggaagggaaacaggaattcgatttttttacttgccaaatatttactgaccacatactatgatgatagcagtaataataatgggtaaaatgtattgagagctcagtataaaactatgttttttgcatatattt

SEQ ID NO: 262140 - DNA, 468 bp, Homo sapiens
ccattctaggtctttcccagatctaggagagattaaatgagagtctgacaccttttaggtctaaaaagaaacatttatcatctattctctctgaagcctgctaccttgagatttcatctacataaaaagaaccttggtttccacaacttcccttatctgaacgcaagcattactttctactgacttcaagtctttagagatagcttagctctttcaaccaatcagaaaatctttgaatccacccataagcccccacttcaaaatgccctgcattttcaggctgaaccaatgtataccttacgtgtattgatttatgtctttgcctgtagcttctgtctccctaaaatatataaaaccaagctgtaacctgaccaactcaggcacactttctcagaacttcctcgactctgttccccagactgtggtcactcacattggctcagaataaacctctttaaatattttaca

SEQ ID NO: 262141 - DNA, 444 bp, Homo sapiens
acaaaaatgccatgacttctaaaactaagatctgatctccaacttaaaaaccttctgtctctgttttgcctgcagagaagtataaattcctttggagaatgaagctgctttccaatgcttgctgtaatagccctctgcatctttctttcataacatccagtacaatttgaagttatatattgggtgattgtttgattaatgtttgtctttctgaaattttgaggtagcatgatcatataacttaaagtgtaaatgggaacacttttgaaagtaaaaggagatgttattaataattattccaggacaaaaaggagactggaacatgtggtcatcctacaggtgaagcagagaccaactctggtttacttgtcattgcagtcccagtgccagattccatacttggcacagagtagatgctcaataaataaacatgatgattgattt

SEQ ID NO: 262142 - DNA, 536 bp, Homo sapiens
agctcagtgggaaattggatgctttccaataaaatattattttaaggtgattttaaattttactgaaggaacagtaacttcttgcttattataatttaaatacagtagttgagctatttatgaagtaccctctttgtgaatggaatgatcaataccaccttcctaccaaagtctccattccgaatgctgtgcatcttgccggtgctgtgttgggagtggtgttgctggaaaatacggtctttgcatatttattaacacactttttgacttgtttactggcagacttgtaggtacaattttaaatgtaatcttttggaattttatgaactgagagttcactcttgtagtgtcattcaacctgtgctgcctcccctgacacagctgttgtggccggtcaggatacgtcctctttcacatctctaatggaatctaaatgtggtttgccttctctgtagagctcttcttcaccgaagcctggctctgattataagtgtgcaatatgtgatcactgtaaaaaaagaagtgtaaaatatagg

SEQ ID NO: 262143 - DNA, 610 bp, Homo sapiens
gcatttacttccttcgcatctggtgtagttaaatcctgaagagtattaaggcacaaacctaacccaacattggaatagataaaaaatgtcctctgaattaagtcctatatgacttcatgggtaatttcaatccagacatatgcagaaattttcaattattttttttttgagatggagtctcactctgtctcccaggctggagtgcaagtagcacaatctcaactcactgcaacctctgcctcctgggttcaagggattcttctgcctcagcctcccgagtagctgggactacaggtgcacaccaccacgcccggctaatttttgtatttttggtagagacggggtttcaccatgttggccaggctggtcttgaactcctgatctcaggtgattcacccaccttggcctcccaaagtgctgagattacagtcatgagccaccctgcctggcaagaaatttttcattctgttacacaaaatatttttatagctgtccccaattttaccttaaaattgtgaccactgcacaataggaatgctgtgtttgtaacattatctcctggttttgtggtcagcttgctactttaattcagtccaaggccctatattga

SEQ ID NO: 262144 - DNA, 424 bp, Homo sapiens
agaacagtctatgggttacttccctaggaatgaggaagatgaagagctagataacaatgctgggctggtatctgcctgatagtgctttgccaagactatggtttcttcctcttctgatcaaaaaagacacaggagtcagacaaatggggattaaaagacaactgagttgatgtgaaatgtaacaggcaacactatggacacagaaagtagattagaggctgcttaggacctaacgtggagggcagtaggggagcgacagctgaagggtatggagtttctccgtgccgatgaaaatgttctacagttgactgtggctatggctgcacatgtctgtgaatatcctagaaaccactggagggttcactttaaatgggcgaattgtatggtatatgaattatgtttcaataaagctcttacacagcta

SEQ ID NO: 262145 - DNA, 370 bp, Homo sapiens
cagagatcgcaccactgtactccagcctgggacagagtgagactccatctcaaaaaaacaataaaacaaacaaaaagtggttccctatatctctgtctgctggtattcatgcccccgtgtacctccgttcccttgtttgtgagctggacctagcaactcacttcaaacaaacagaatattgcagaagtggtgtgaaaaagcatgcaccctgctctgcctccatgcctgcccgcaagttttacaggagccggcccttgcggttgacctcaggagtgaaatattagcaaacctgcctgcctagcagacctaagccatattgtccagtatcagttttgatggtaataaaagtaatatttgtatttccatctgc

SEQ ID NO: 262146 - DNA, 624 bp, Homo sapiens
atgtctttggactagggcagaaaaaggaactaatcctgtgctcaagtctcccaattaacagtgaacatcaaagacaccaattttgaacatgagactgagttgttctgtttgtatgtttgtatctgcagggaaataggaaggagatgaaaactgtaaaaaagaactgctctttaaatatattctaattacttcaagacttgcaagaaattgaataagtgagataatgaaaatgaatgagtcaagtttggggttttctgtctggttttgatcaggaagtctaacttttggcatagaccttcaggaacttgtaaaaacattagttgattgttggttctctcaaaggccatctcctctagggaaaagttggtaatcagaagggcatccaaccttattctcaagagttcttgtccctgaaaggattctctggagcactgggctatccagaagggagaccatgatcctggagcttggagctcttaggcccgcttctcaatgaagcatgtgtgggatcacaaggaagatgttaccttttcatgtacctcgtcaggtatcatacccccatgtaacagaggcaattcatcttacccaccactgcctttgtgctttaagaacacataaagattt

SEQ ID NO: 262147 - DNA, 452 bp, Homo sapiens
agcaagaggacagtgatagggaataacttcaagtagctgtgtgtgtcccccagttctgcattattagggcgatgttccatgatcgtgagtcattgctgtgttccagagaccccctctctacatggctagaggctaaaggtcattatcaagagtgaatactgccaagtccagcagtgaaactgttctgtctgatactataaaggaggatacatgttattacatgtttatcaaaacccataaaatatacagtgccaaaacggaaccctcctgtgaactatagactgactatccttaatagtatgtcttcagcaaatgttgggttcatcagttgttacaaatgttccactaaactaagatgttaaaaatgggagaaattgaagatgaggagaggaaggtatatgccaattctctatttttcactcaatttttttccataaaccaaaaactgctca

SEQ ID NO: 262148 - DNA, 436 bp, Homo sapiens
  misc_feature (406)..(406): n is a, c, g, or t
  misc_feature (408)..(408): n is a, c, g, or t
aaatcatattccattatttcattatatggaagtacctcagtttattcgtctactgaagggtatcttggctgcttctggtttttggcagttatcatgttttggctgtcaacatttgcatgcaggtttttgcgaaacaagtcttcaaattagttgggcacatatataggagtgctattgccagctcatacggtaagactatattttgctttgtgaggaactgtcagtcttccaaagtgatttttacattatattttacatttgtaatgcaatgagatttttttgtcacaatctgcatgcccaggatggaatcatttacattttcatatcctgagattgatttttgtgtgtttgctgtaaagttctatgaatttcgacaaatacacaatgccatgtatccaccattatnanatagagaatagtttcgctgctcttaaga

SEQ ID NO: 262149 - DNA, 497 bp, Homo sapiens
aatcccagcactttgggaggccgagacgggtggatcatctgaggtcaggagttcgagaccagcctgaccaatatgatgaaaccccatctctactaaaaatacaaaaaagttagccgggcatggtggcatgtgactgtaatcgcagccacttgggaggctgaggcaggagaatcacttgaacctgggaggcggaggttgcagtgaactgagatcacgccattgcactccagcctgggcaacaagagcgaaactccatctccaaaaaaaaagagaattgtatactcaatgttaaacttggtggaacttagaaaatatatatgtatattggcttacttacttggaatccatttttggtcctgattttgcttattagtatgctatagtaagatgaagaatacttcaaagtttttatatccattttaatatattctgtcatctgccactaaggtggatatgaaactgagtatttttcatgggaataaaatgtggaaaacttg

SEQ ID NO: 262150 - DNA, 399 bp, Homo sapiens
taagcactcagcaattaacctagtcaatgatatgtgttgactgtgggtgtgacccaccatgtctgttgtgatttttaacttcagagtatcttaggaattatccagtccagctcattttatacttcaagaaactcaggaaaccaagattaggttaatcttctaaattcacagtactagctagaggcagccccttctgggacaggagtcctagtctgtttggtttcttttttttttaaacccaccatattgctaaaacagatagcaacaccagcttcctcatgcagtgcagtcatctactgtcaacacaggtcttggcttctttcccttcagcgtctcacccatctttcttaaggaggatccagatttctccaaatgttaccttcatatgggaccctattc

SEQ ID NO: 262151 - DNA, 876 bp, Homo sapiens
gcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccgggagcaccacgttctgggcctggagtgtgctgcgtgtcccagccccgcccagccctcagccagccacctacacgtgtgtggtcagccacgaggactcccggactctgctcaacgccagccggagcctagaagtcagctacctggccatgacccccctgatccctcagagcaaggatgagaacagcgatgactacacgacctttgatgatgtgggcagcctgtggaccaccctgtccacgtttgtggccctcttcatcctcaccctcctctacagcggcattgtcactttcatcaaggtgaagtagccccagaagagcaggacgccctgtacctgcagagaagggaagcagcctctgtacctcatctgtggctaccagagagcagaaaggacccaccctggactcttctgtgtgcaggaagatgcgccagcccctgcccccggctcccctctgtccgccacagaacccagtcttctagaccagggggacgggcacccatcactccgcaggcgaatcagagcccccctgccccggccctaacccctgtgcctccttcccatgcttccccgagagccagctacacccctgccccggccctaacccccatgcctccttcctgtgcttcccccagagccagctagtcccacctgcagcccgctggcctccccataaacacactttggttcatttcacctgact

SEQ ID NO: 262152 - DNA, 276 bp, Homo sapiens
tggggaggttcacgtggtgaaaacaggtctctggccaacagtcatgactgtgccatcctggaggccgatcctccagccctagtcaataactgctgccctggcctacagtttgtaatctcatgggagacctggagacagaaccacccagccacgcatccccaaatccctttacctctaaaacctgtgggacaacaaatgtttattgcgttaaactttggggtgattgttatgcagccacagagttctaataaactgtcggacatagattactggcta

SEQ ID NO: 262153 - DNA, 677 bp, Homo sapiens
atgttaaaatatttaaatgaatctttatagaccaaataataaaatagatgtatcaaagagatcagagccctaaagagttcattttcaccactttttgagtacttacagaaattaagaacacataaaataatctgccttacattctaagaaatagacaaattgaaccctctcccccaatctctccatttaaatataggaaagagctatttgcagcaagactagaagtaaagtttgtctaggagcactgttgctaccagaaagaaccctaatgagagatgccatgtatttctgcagcagctgtttgtatgcagacctacttactccaaaatcatgcaagctcatcttaataggggtctgcttcgcaagcaggcagggtgaaattcacacatttggcttagatcactgtttacaaaggaaacacagctagtcattacatttaattagattgcaattatatgacagaatatcatacttacattttcatatatgttcaatgggtatctttgtctgctaaataagatttatatcttctacaccagctgtctttacttcaaagatggggatctttgggatgctggtatatgggaaagtatgttaaaagggagggaagcagacagcaaaagcaaactaagtctacttaactatttttgcctttaggccagccctgaggttagaag

SEQ ID NO: 262154 - DNA, 2082 bp, Homo sapiens
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgcccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgaggggggccgacccccatctccaccccgcgggctctccaggagcctcagcccaccgccagtactctcccagcaaccgcgagcaatttcttgggaccaaagtcaatactccggagggtcaagagatttcgagcacgc

SEQ ID NO: 262155 - DNA, 422 bp, Homo sapiens
ggacacactgtgtaggtacaataaccaggaaggtgtgaggttggtgtaaggtagacatttagatcagtggactgcaatagaaagtccagatgtggacttttaaaaaaattgaggtgaaatttacataacatacaattagccattttgaagtgtctaactagtggcacttagtgcatttatgtgttgtgaaatcacaaggttagatgatttttgttttaaccaggtgcttaggtaattcaattagaaaaggaaaatcttctcaacaaatgatgctgaaacaagtagttagacagatggagagaacacaaatttcaacttctctctcacacacacatacaaattggagatcaatcatagatcaaagcataaaatcttaaactataaagcttgcaaaagaaaataaaggaaactatttcctcaga

SEQ ID NO: 262156 - DNA, 405 bp, Homo sapiens
tggggaccctgcctttcaagtcgtttgtgtgagggctgcgttggtggcccaactagccagggaagggctatggtatgcggggtcaggcgggaataggcaggaaatgtttgtgataagaggcttcgcctcttgcaagctcctctggtttccagacccagctgcaggataagggcccaggagctgagcagggagcctcagaggaggctgctgcaagagccagctcttgggatttcagcaggcagagttgcaatcagaggcccctggggtccctgaagaccatgcctggggatagaaacgaccctgggaacccagccagggctgccttcctttgggatcagggattttcaatcatacttcagagggccaaatcaatcccttaagaaaaataaaacaaaacaaacccca

SEQ ID NO: 262157 - DNA, 253 bp, Homo sapiens
agactcagatcccttctaactttgagacacggttttccagagaaactatgaatattgagaaaacagcagcctccaaagccgccaagacttgatattttcattacgcttggttacaagctcgttgaaaagtgtttccggttcatccttgaatctcttccaatctaagcacaatgctgtgcacatgagcaggtggctttgtagtctatagactcctcctagacttccttttcctagattttaagtcaaattttgc

SEQ ID NO: 262158 - DNA, 623 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (18)..(18): n is a, c, g, or t
  misc_feature (54)..(54): n is a, c, g, or t
  misc_feature (534)..(534): n is a, c, g, or t
  misc_feature (574)..(574): n is a, c, g, or t
actttgnananttgcggngtgagaagcctcttggccagaacttggggcaaggcncaaatctggtatgcagactccacaggtggggaagaaccaagctcttttctttcacagctgggaggtgggtagcctggggcaagttttcatgcccatctcggccaccaccacctggtaacagattcagggctgttgggtggggcacggtgggagtgagaccgactcttcaatttgcgtgggagctgggtgaggcctataactgctgggtgaggcctataactgctggctttcccccatgtccctgacaacctgcatgactcagcacaggcagccataatcctcctaggcacacaacttcagtgacctgggaatctcacccccatccctaacagcagcaagacccacccaaggagagtctgagctcagacacgcctacccctgcccccacctgatggttcttccctacacacactggtggctgaagacaaagggcttatactcttgggagttctagggccttacccaccaccagtacctctncatactaccacagctgatgctttctggaaagtgccacctnctgcaggaggtcaaacagcacaaaaatagagcattaaaccaccaaagta

SEQ ID NO: 262159 - DNA, 533 bp, Homo sapiens
tcacaataaaataggcaataacatatatataggcaataaacatatatgtttattgaaactataaacacatatactaacaatagttgcatgggtataacaggagcagacaaaccgtattcataaagaatagggcgaaaggtgaaatgcataaacacatattattgtggttggtaattgtgcacccagctttgttactgcagtcatctgaaatactgtgatgatgaacaagctgtcttttgatgagatcagtcaaaaaccatagtgagtcaccactgcatttgtagttgcccagagaactgaaatcttgagaaattttatcttttacaagtgcagatgtatgataaaggacatctgttcattgattaagtttcagtgtttttatatacatacacaatgtttacccagaaagtaaatgttgtggtaatgcattttcatggagttaaatttgcaaaaaatgaatacagtaaattagaactctccaaaaatttctacataattaaaaaatgctaacaatttaagatagtgaaaataaa

SEQ ID NO: 262160 - DNA, 466 bp, Homo sapiens
aaaaaggatgtatattctggtgttgtttggtaaaatattctgtgtttatggatcctgttgattaatgatgttattcagactttctatattttcctcattttttgtctaatattttgctaaaagaaggatgttaaagtccccaacagtaattgtggaattttttatttcttctttcagttctatcactttttgcttcatatatttgaatgttctcttgtttggtgtatatgcatttatgattattatatcttcttcatgtattgtccctcttatcattatgaaactttcctctttgtccatgttcattttctgagctctgaagtatactttgtcttacactaatacaaggtataattgctgcatttttaaaagttaatgtttgcatggcttatctttgtccatttcttttattttcaacctgcctacatcattatatttgaagtaaattttatgtagacaacatgta

SEQ ID NO: 262161 - DNA, 386 bp, Homo sapiens
agtggcaataataatattaggcaaacaaatttaagacaaaaagtatgaagatggacaggaagagaagcattggataatgataaaagttatccacaaaataacaggcatgagcctttacatatcgggtaaaataacatccaaatttaccaaaaaaaacactctacaaaatattagataaaagttattaaaatacagccatagtaggatacttttcctttctcagaatgtaaaaggtcaagccaaccaaagatgaatgaggccttaaaggatttaaataccagacttaaaagtttgtataggtataaaccttgtactctgacagaaaataaacatccatttcaaacagctacataacatttacaaaaactgatcatatttcatgttac

SEQ ID NO: 262162 - DNA, 681 bp, Homo sapiens
agtcactcttgcctggcaaagcccttgggtgagatctcgtgccagaacgctctttcagcctgggtgtccctgcctcgccctaccatgtgggcttagaggagaggcaacttggaggcaagcctgaaaaccacctctccatgaggagtgggaaaagccacaccctcgactcttccaagactcagggcttcgtagacaccagtggagtggaggagaagcagatgagggactgggtttcttggctcatctgtcagatgggaatttggggcataatagagcaggcatttggggcactaatagagcaggcattgctggtttccttctgcaagacaatgaacagctgagctggagtggttttaagggtcgctgaatgaatgctgtactgggtatgagacctgagtgccaatcctggcacctccccttagccacacactccttgggtaagtctcccattctgagtttcctaaggcagcctaagatttcacggacctggggacagacttctgccccaagacatactgaacacatggtcctcagaactcctttctcatcctcactgccaggagggggacctgcacaactcaggctgcctggaccctcccagcttgcacctaagattttggcgtcatggttgttaaaattgatattgcccttccatttgctccaaaagtttgaacagtaaat

SEQ ID NO: 262163 - DNA, 325 bp, Homo sapiens
tgcattcctgggatgccgttcacaggccttagcaagatcatctgacagccgcctgtgaggtcaacgaactttatacataattaaacactcccagttaggagaattcatttctttctccctgagaagcagagaaagaatacatgttgtgttgccctccattacggagtaaaagttgtgtggagtaatcaggctagtttcacatgatttaatgttgaaccgaataagaaagtgattgcatcctctactgggcctcacagaaaagtcaccacccacattgtttattcagactgggatcttggccatttggggtttaagccagaagaaa

SEQ ID NO: 262164 - DNA, 662 bp, Homo sapiens
aagagttggaccctcagatgaaatctgactgtaactgggccaaattgtaaaaccagctgcatttgatttgaactgtttatgctttgcctgatcatcaacctgaagagtgtaaaccaaaaattatatcctaagcccccaaccaactgaacagacagctgtctaggccgaggggaccccagagcaagctgaaaaactaaattccaggccatgatgggaaggaagggttggacgtacctcattatactctctcccttttaaagtttaggtataacagaccagcattaatattaaaatagagatcataagactgacaaaaacagactctttggtaagaagataccaaattccaactggtataatatcacatgacagataacagaccttgaagaaaattaaaatattttacctcaaaatatatttctttggcatattttgaaatggtcctgagaagccatcttttgagaaagaaattttgcatctgtagaggatctttattaatgcagctaggcttttcccagatctagcagagattaactaagagtctgacacctgtgaaattccaaaagagacgtttaccatctattctctctgaagcctgctatctgaggcttcatctatataacaagaatcacagcccacccccccttatctcaacccaagca

SEQ ID NO: 262165 - DNA, 381 bp, Homo sapiens
agagcttggcacattagaggaaagaataaaggccagtgtggttagtgagtaatagggagaggggtacagaataccactggagaagagggtgggagctattagtttggtgcaaaagtaattgtggtttttgtcattagtttcgcttttaatggcaaaaaccgcgattacttttgtaccagcctaatactccatgcagggccctgtgcatcagatacagagtttggattttattttatttttatttttgagacagagtctcgctctgttgctaggctggagtgcggtggcgcgatctcggctcactgcagcctccgcgtcccaggagaatcgcttgaacccgggaggcactccagcctggcaacagagtgagactccgtctcc

SEQ ID NO: 262166 - DNA, 342 bp, Homo sapiens
tctatttaggttcaaattttaaaatattatgtttttatataatctatatctttatataaaaacccacaaagaaatgcatcaacatattactagttgttatatttaggtggtggaattatgggtgactgttttcttctgtacactaaaagaagcatttttttaatattaagaaaacaaatataaaaataagctacaaggaagaatgaataattactctttgtgtttctctgtggaatgaattagttggacaaaaaaggtgggtaatgggagtgagagggggatgactacaatctgcctaacatgccccagctgaatgtttgttttaataaatttgttacttga

SEQ ID NO: 262167 - DNA, 130 bp, Homo sapiens
ccccatgtaggcaaaaggagacacctaaaacatggtccctgcctttgagaagttcggtgtggttcccccagcagccactttccccgctttttgctcacaaaatctgtttgttgcagatgaaaataggcct

SEQ ID NO: 262168 - DNA, 692 bp, Homo sapiens
cttgacaaaaggttttgagcagtttatttttatgcctgagacaggatcctaaatattttcaagactataaagaatccactaggatgctatatagcaattaaaatttcaaagacttcacaatggcagctataagagtaactaaaatcaaataataataaagtgttccatttactcagaaagaagcacaactggtgtaaacaatgttaacgactcaaagattgggatcaaaagttttgagtgcctttaatgtcatatccactattaagtgtccatttcgctctcaagtaaaccttgttagaaatcacaacctaggatggttttttgaattctaatggatatcaggattgagaaaagaggattttgaagttttgcttgttgttcctgtcttttaaacaggtaagggtttgtttgcttgtttgttgttttggtatctgggcagggggcagggtcaagagatagtcaataggtagtcagtaggagtcttggaaagcaatctacttttgctaaccgacaggacaagaaatggcaatgttctattttatagacagtttctgtggcaccgagttaatctgctgcctgcatgtttcaaagggagacacaaagcagagcaatggattctctgggacaaaccagacacttaaaatttaactcacgctgtggctgcaacatcctctgagggtcccttcttctgg

SEQ ID NO: 262169 - DNA, 216 bp, Homo sapiens
caatcacctccacccatcccctcctgcccaagctctggcttaggatagataaagcttctcctttttctgtttgcatggaatcttctttacctccattatcataattcagtgactgcaatcttctcgaagacaaggaatactctttcaacacaatgaatgagcactagaccttacttagagagcacaaactataaaccatagtctgtctggaggcca

SEQ ID NO: 262170 - DNA, 367 bp, Homo sapiens
gaggttcagaatgcatctttaaattgatatgttttctgtaaatctaaaattacccaaataaaatgtccacttaaaaaatcaatgtaggccaggtgcggtggttcacccctgtaatcccagcactttgggaggctgaggtgggtggatcacctgaggtcaggagtttgacaccagcctggccaacatcgtgaaatcctgtgtactaaaaatgcaaaagttactcaggtgtggtggtgcgcccctgtaatcccagctacttgggaggctaacgtgggagaattgcttgaaaccaggagacaaaggctgcaatgagccaagatcgcaccactgcactccagcctgagtgacagagcgagacaacatgtca

SEQ ID NO: 262171 - DNA, 367 bp, Homo sapiens
ctccaatgttaactttgctaaggtgtctttaagaccagagaacaaggaagagtcggcagtagtaccctggaaatgctaaatgaaacactcttccttatgttcttcagaagctaaacttttactacataaagttcgagatgaggcagcagagtgatcataaacaatagctttgctgagctcttcaacccacataattttctagcaaataaaagatgtagaagacctgtgtgagaggaatattctactttaaaacgatgtggcctgaaaattgaggaataagtgagatatcctttttaatactcccttagtactccagtctttttaaaaagcaaagaagtaacaaggcaggatgaaatacaagagagca

SEQ ID NO: 262172 - DNA, 251 bp, Homo sapiens
tctgtggtggagtcgttggcagaggatggctggatgtacatcagacccatttcttcttcctgggcccacaagtaaactgcatttcccaggcctcttgtagccaggtggagccatgtgactagttctggccaatggtatgtgagtagaggtttctctttctttactccgtcagctgctgaggacagggaaacctcgaaggctgtgttaaagacgctggaaccacatgctaataaaaatgagcatctatgaaa

SEQ ID NO: 262173 - DNA, 393 bp, Homo sapiens
gaattcgtttatgtgcatgagttagctgagggacaactgatttgcattatgctcagctgggattggcttcaatctgcaagtcgcatccagatccattcctcatgtctcccacggtcctgaaaccaacaagctctcaggagaagttgatggtgactgaaattctgaaaatatgcagtcagcacttttgtcttcatggaaagtgaacacatttggaaatattggctcagcattgcagctataccctttagacaggaaacacactttccagttctccttgacagagaggctgaagatagagtgggaagaaaaatgttgatatttaaaactaaagtaaaaaagctacagaagcttctactatttcagataagtaaaataattcatgcaaggtgatac

SEQ ID NO: 262174 - DNA, 418 bp, Homo sapiens
ataatttttgaataatgtaatatatagatatgagctgctgtattagggttctccagagaaacagaaccaataggagatatatatatataaaatacatttctataaaatatatataatatatattctatatatagaatatatagattctatatatatatagatttctatagaatatatataaatttctataaatatatatatagaatatatatggaaagagatttattataaggaattgacccacatgattatgcaggttaacaagcagccagatctgcagtctacaccagaagagccaatgccataacactcccagtccaaaggcctgagatccaagacagccaaagctataattccagtccacaggccaacaggctctagacccaggagccaatctttcagtttaagacggaaggca

SEQ ID NO: 262175 - DNA, 374 bp, Homo sapiens
cagggagcagagagaaaagtagactccccaatgcctcgcagtaaatgaggacgcctggcgcctgcggcgaggtcaactgaggtcagacgagcttatctctcctgtcccgggaattaagggcatcctggggacagctgcagagcaggaggctccccgtgccctcctcttcctaagcaagtcaggatcccaagaggcgcgtgcggggaggcccctccgaagggctgctggcttgtgtcttccaccagcgcaaagggaagctatcggttgcttctgcagtgaggcaagctcagccggacgcccagaagagagacgaggtgtcgctgtcggggtgtctgcctgcctctttaggatcaattattagcgtacagatccta

SEQ ID NO: 262176 - DNA, 681 bp, Homo sapiens
acagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagcca

SEQ ID NO: 262177 - DNA, 832 bp, Homo sapiens
tgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactgggtaatttata

SEQ ID NO: 262178 - DNA, 754 bp, Homo sapiens
cagtcctcccacctcagcctcctgaagcactgggatcacagatccagcctatcttttaggattgagacctgttaaacttgcaaatgaaggggtactttcaagctgttggtgatgtttacaccttcctgagaaagaggagcttgggttcttgggttcaggtaggaggtggagacattgattattcactcctccccttctcgtgtacaccctcccccaccccattttttattaattaaagattaattgccactcagaatgtctgttgacaagaaagttttaccactgaagctgttagaattccagcccaaaacaaagaaagaaatctagagttagcctgtatgacctcctcccagataaatggactacaagggtgaaacttttttaaacactggggatagcttggaggtgtttttgaagttccccactgggatgctgtcctggtttgggaccatctggtctagagatgacaaaagtgggttcccagcctgaagtttgctctgggctagcatttagggtacctcagtggagttcagtgggaaatttgtgaaacctaggccagctgtggagctggtataggagtctttaccctaagagcagagggtttaaggttcctagagcggatcagctggtcaagttttgtgaatagattctatgatgtcaaggctccttcagccctgacatttgtgctgtgtccaccatctggtgtcttcttgctttacgtttcaagtctttgtatccatggtggtgggattta

SEQ ID NO: 262179 - DNA, 812 bp, Homo sapiens
cagtcctcccacctcagcctcctgaagcactgggatcacagatccagcctatcttttaggattgagacctgttaaacttgcaaatgaaggggtactttcaagctgttggtgatgtttacaccttcctgagaaagaggagcttgggttcttgggttcaggtaggaggtggagacattgattattcactcctccccttctcgtgtacaccctcccccacctaaaaaaaagttataggagattttctctgtcaaactatcaaactgatgaatttgtttcccattttttattaattaaagattaattgccactcagaatgtctgttgacaagaaagttttaccactgaagctgttagaattccagcccaaaacaaagaaagaaatctagagttagcctgtatgacctcctcccagataaatggactacaagggtgaaacttttttaaacactggggatagcttggaggtgtttttgaagttccccactgggatgctgtcctggtttgggaccatctggtctagagatgacaaaagtgggttcccagcctgaagtttgctctgggctagcatttagggtacctcagtggagttcagtgggaaatttgtgaaacctaggccagctgtggagctggtataggagtctttaccctaagagcagagggtttaaggttcctagagcggatcagctggtcaagttttgtgaatagattctatgatgtcaaggctccttcagccctgacatttgtgctgtgtccaccatctggtgtcttcttgctttacgtttcaagtctttgtatccatggtggtgggattta

SEQ ID NO: 262180 - DNA, 983 bp, Homo sapiens
  misc_feature (794)..(794): n is a, c, g, or t
  misc_feature (799)..(800): n is a, c, g, or t
  misc_feature (803)..(803): n is a, c, g, or t
  misc_feature (806)..(806): n is a, c, g, or t
  misc_feature (815)..(816): n is a, c, g, or t
  misc_feature (824)..(824): n is a, c, g, or t
tgggtctttgctcttttggggtctttgctcttttggggtctttgctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatgganccttnngtnggntcccactcnnccaatgantccggcgtttcacccggttgtacaaccaggcaaatatggtggaaccctttggtggggacgcctttctcctggggtcgccggcttgacgagggttagggcccagggtatggggcggaccacggggaccgggctgctctagagggaggtggtcgtttttgc

SEQ ID NO: 262181 - DNA, 613 bp, Homo sapiens
  misc_feature (6)..(6): n is a, c, g, or t
ccccgnactagcccgacaggaagcgaggaggtacctcacagggccagggtggagaactagcaggaggccgtcagcagaggggtgggaacttacagcaggagcccaggagctagtgcagggaccagagggtgacaatgaaggctgacatcatggagaggcagacccagcactgggagtacgcgagtgggagtggagagtacccccagcatccccaaatggcaaagaggccttgacagctttgtaacctgcccaaaggcctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgttgctagtcggggactgtcgggctagtcggggactgtcgggctag

SEQ ID NO: 262182 - DNA, 1694 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262183 - DNA, 7566 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262184 - DNA, 674 bp, Homo sapiens
  misc_feature (48)..(48): n is a, c, g, or t
  misc_feature (136)..(136): n is a, c, g, or t
  misc_feature (188)..(188): n is a, c, g, or t
tgaaactgagtctttctctgttgccccagctggagtacaatggcacgnatcttggctcaccacagcctccgcctcccgggttgaagtgattctcctgcttcagcctcccaagtagctgggactacaggcgcgcacncaccatgcctggctagtttttgaaattttagtagagatggggtttcactgtnattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgcttgggatcgtagggccctgtagggacaaggtagagagcctggccaaggtagagagcctgcca

SEQ ID NO: 262185 - DNA, 205 bp, Homo sapiens
  misc_feature (42)..(42): n is a, c, g, or t
gaaggtgcacacgcagtgtgctgtcccgcttggatctgacgnaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccaca

SEQ ID NO: 262186 - DNA, 8155 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262187 - DNA, 8270 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262188 - DNA, 8320 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262189 - DNA, 8333 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262190 - DNA, 5355 bp, Homo sapiens
tccgataggcggaattgttcacgagggaggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262191 - DNA, 5670 bp, Homo sapiens
tctagaggatcccagacctcggcaccgttccccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262192 - DNA, 8492 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgaatggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262193 - DNA, 4553 bp, Homo sapiens
cgactcttgagatccccatgttacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262194 - DNA, 9246 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggaaaaaaacaaaaaaaaaaaaaaaaaaaaaaaaaaaaaaaacgggggcggcgcgccctcaaaaatttcccccaagggggccccaaagttacgcgaccccagttttcttgtgacaagagggggccccaaataaggaggacggccggtatatataataggccacagagcatgggcccggcgcgatataacaacaggtggaggagtgggaaaaccgcggctcaccccggagacctctgaggaagaggagaacccctcaacacgctggggggagccgagcccaaatatggggagcacaacctatcccaaccacgacatttttacaacggcactctaacagggataacattatctcgaatctttcacaacgcggtgttaaatacggggtgctaacacctcagtcgcggcaatatatcacgctagcgacacgctcgttgaaaaacgttttggcgccatcaccccggagcgtaactaagtagctgcgagcacacatttattctacgaaggagcgcctatcgttgtataataaaagggggggagacgcggggaggaggcaccggaggcgaggaagggagctgggcagagcgcaggcagcccagaggaggacgacgacgagggaggagcgaggaggcgcgtccgggagcggagacacgcgcggacgaggtgcagggtgtggcgagaaaggagagggtaggcggagagaaggcccgctaccggagggcgaagcagggacgggcacgggagtgcgatggagcagagagcgagcgtatagtggggagcttaggacagagagcagcaaaataggacggacgacgacgaagaagatgaagtagagaggcgtgaggaggggagagggaaagagtcatgcaagaggagagagcgatgagattggaaggtggaggagacggggagggcggatgagcaagggcagagattgagaagaagagcagagattgaaagagacgaagtgagtagtggataagagcagtagacgggaacagatggaaaagacgagaggaggagttgagagagacggaatgagacagggacgcggggctccgcggtccgggcgagtggggtgacgggcgctagcacgc

SEQ ID NO: 262195 - DNA, 4208 bp, Homo sapiens
taatcgagctcggtccggattgcgattcttgaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262196 - DNA, 8215 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgaatggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262197 - DNA, 4150 bp, Homo sapiens
tagaggctggggttaaatcggacgaggaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262198 - DNA, 8352 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagtgcctacctggtcaaaaacacggaagtcctacagctttccgcccttgtggctcggcttggggcaaggcgactttggcctcgagcaagcttatccaagcctccagaattctagcctacttgtccaattcgccctatagcgaggccgtatatcaattaaattggccgccgctttaccaacggggggactgggatgaaa

SEQ ID NO: 262199 - DNA, 8249 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262200 - DNA, 8144 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagctcgcccctaagttgcagctcgcccctgagttagcagctcgcccctaagttagcagctcgcccctgagttagcagctcgcctgag

SEQ ID NO: 262201 - DNA, 3070 bp, Homo sapiens
atgccgcagtatcgtaatccctttgaaaaaggtgatctttacataaagcttgtctgggttgatccagttgttttcaggaaactgccagaacacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262202 - DNA, 3065 bp, Homo sapiens
  misc_feature (10)..(10): n is a, c, g, or t
  misc_feature (24)..(24): n is a, c, g, or t
acctgaaagncggaggttgcagtnagcccagattgcaccattgcactccagcccgggagaaagatcaagaggccattgctcagaacacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262203 - DNA, 7966 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcgatccgcagagtaatcatcccagctggtgtaatta

SEQ ID NO: 262204 - DNA, 7955 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctacagggtaccgcagctcgaaattcg

SEQ ID NO: 262205 - DNA, 2905 bp, Homo sapiens
  misc_feature (110)..(110): n is a, c, g, or t
  misc_feature (217)..(217): n is a, c, g, or t
aaggatctgtgggcccagttttcttaccccttcaatgtcctgatcattgaatttatattagagcttctttaatagatattcctttttattgatttcatctagagtgggcnactgcatgccagcagagaacatctggatcaaaaacacgatacgagattattagtaagggattttgatccagatgttctctgctggcatgcacttacttccctacctnggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262206 - DNA, 8074 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggaataaataggagttcaggggct

SEQ ID NO: 262207 - DNA, 7814 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgttcccttctgtcgtcttctcaagatcctgctagagtcaccccg

SEQ ID NO: 262208 - DNA, 2537 bp, Homo sapiens
cgtgatggctgactcttgaggatccccccgcggcgtgtcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262209 - DNA, 2507 bp, Homo sapiens
ctagctgactgaattggctcgattaatggtcggggaccaccagagggtgaatctacgattgggaatctggttcagtcctgatcgctgagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262210 - DNA, 2133 bp, Homo sapiens
tcgtcatagcctgtttcctagagtaaaacccctatgcactttgtcaacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262211 - DNA, 2113 bp, Homo sapiens
tcagctcggtccagtgtactccacaaacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262212 - DNA, 2003 bp, Homo sapiens
tctatagctgctctagagatccccggcaagcctcctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262213 - DNA, 2168 bp, Homo sapiens
  misc_feature (22)..(22): n is a, c, g, or t
gtccacacgtccgtgtggcggnacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatttcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262214 - DNA, 1902 bp, Homo sapiens
acggctaggtagaggcgggtggtaatcggccgaggtctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262215 - DNA, 7579 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaaaggtcagatatgcagatgaacttcttaagcacattcttgggacaggcgctgtaggtt

SEQ ID NO: 262216 - DNA, 1794 bp, Homo sapiens
tagcgatccccttctacgagcgcaaggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262217 - DNA, 1677 bp, Homo sapiens
tgggtcgttctcggtgggtcgttcttcggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262218 - DNA, 8095 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcaga

SEQ ID NO: 262219 - DNA, 7496 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccacccagaaatactggattgacatccagttgcgctggggggactatgattctcacgacattgagcgctacgcccgggctcaagttcctggacatacaccaccgacaacgactacgcgggtat

SEQ ID NO: 262220 - DNA, 7426 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttccctgggctgccgacgcccatagagaatatgatccttcgatacgtgaaggccaaggctgactggtggaccaacactgcccactacaaccgagaacggatccgccgaggggccactgtggacaagactgtttgta

SEQ ID NO: 262221 - DNA, 7607 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacggtgcccagcgctgggcactcgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttcatgctccaagactccctggagcacgtgcagctgtttga

SEQ ID NO: 262222 - DNA, 7328 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgggatacaggtaagagacgatacacatccctaatgatcaagcggggatcttgatatgtatgagattgcc

SEQ ID NO: 262223 - DNA, 1456 bp, Homo sapiens
tgggtctttgctcttttggggtctttgctcttttggggtctttgctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262224 - DNA, 5609 bp, Homo sapiens
  misc_feature (4406)..(4406): n is a, c, g, or t
  misc_feature (4412)..(4412): n is a, c, g, or t
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttcctggattcctagccttgcagggtactgaggcatgtgctttgcctctgaaatcagctattgtacctgagttgacttaactgctgttggggctttaaaatggaatgaagcggccgggtgcggntactcnacgcctgtaatcccagcactttgggaggccgaggcaggcggatcacgaggtcaggagatcgagaccatcctggctaacacagtgaaaccccgtctctactaaaaataacaaaaaattagcggccgctcgcgtgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262225 - DNA, 6710 bp, Homo sapiens
  misc_feature (6597)..(6598): n is a, c, g, or t
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggagtgcnnttactggcttccccatattgtctcaaggtccggagctccatccttcaggcgtgttccggggaaatccgggatctcttaaccttggcccatggtttttactcttagggtcaga

SEQ ID NO: 262226 - DNA, 1256 bp, Homo sapiens
  misc_feature (15)..(15): n is a, c, g, or t
ggaaattgccccagnccatcgtccttcgccagctagactctgggggaggagataagtaggcaggactatagggagagctgtcaatgtggcgggtgtatcggcgaagtggggacaccattcttcgaggatctcgctgcacccgttccaccagcccatggtgccgagtccgctgcattaatgcagcggactctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262227 - DNA, 1106 bp, Homo sapiens
agtctacacagagctcaaggcgggtgctggaagccagacgtgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262228 - DNA, 6549 bp, Homo sapiens
  misc_feature (6491)..(6491): n is a, c, g, or t
  misc_feature (6498)..(6498): n is a, c, g, or t
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcaaattgggcttaantgggaanacaacttaaggaaggttgggcccgcccctggaacccgaacttttggcctgg

SEQ ID NO: 262229 - DNA, 979 bp, Homo sapiens
tgagaggccggggttaatcggacgaggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262230 - DNA, 982 bp, Homo sapiens
ggacgcgtgggtcgacccacgcgtcgacggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262231 - DNA, 923 bp, Homo sapiens
ggacgcgtgggtcgacccacgcgtcgacacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262232 - DNA, 914 bp, Homo sapiens
tatactctgacgacctttactgagacagggctactaccgtactatcttgctcacgaatagtgccttcgaattacatctagcattcataccttcgggtcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262233 - DNA, 857 bp, Homo sapiens
cctagttttagaagtttcaatagcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262234 - DNA, 5977 bp, Homo sapiens
  misc_feature (5837)..(5837): n is a, c, g, or t
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggnttatgtcgtgagcgcccgagtctcttgatctctaatgtcacattgtcgttttcctggcaggtatatgtaggctttcaggtgcagctagacctgacgggtatctaataaacgtatccgcgctgctgtactccggggacctc

SEQ ID NO: 262235 - DNA, 5219 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgtcctgactgtcagacatccgtcgaatacgcatcctctaag

SEQ ID NO: 262236 - DNA, 4957 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctcc

SEQ ID NO: 262237 - DNA, 5116 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgaatggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctcc

SEQ ID NO: 262238 - DNA, 4539 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttagggcgggcggatccgggacatcagaccgcttccaccggcagagactacagtcagggggaacagtcgggtctgggacaggagggaaaccacctgcgtcaaagggggccaggccacacgc

SEQ ID NO: 262239 - DNA, 4058 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacgcgccatcgtgcgcagtagca

SEQ ID NO: 262240 - DNA, 4240 bp, Homo sapiens
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccactctgacgcaccactgccaatgctgtacgtactgcatttgccccttgagccaggtggatgtttaccgtgtgttatataaacttccctgggtcctttcatgaaacatgcctagtccaacaattttttcccagtgagtcaccatctgggatccagggtttaaatccatatcatgtttgggccta

SEQ ID NO: 262241 - DNA, 458 bp, Homo sapiens
gaggatccccctcttcgctgtgttgagctactgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 262242 - DNA, 1929 bp, Homo sapiens
  misc_feature (1768)..(1768): n is a, c, g, or t
atcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggnagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccg

SEQ ID NO: 262243 - DNA, 330 bp, Homo sapiens
  misc_feature (51)..(51): n is a, c, g, or t
  misc_feature (147)..(147): n is a, c, g, or t
  misc_feature (217)..(217): n is a, c, g, or t
aatgtctcccggccctcattgctggctgactccaagtaagtgcctcaggancccagccctaggcagccaggacactttcgttttcctgttcttctagccctgcaactttaggaattgtcctgtctgcctttgtttcaaacttggagnccagtgctacgcttggagcctgtcaacacccttagtcagatctgctgattctctggggtcctgctgaccntggaacaagttggtggagtgggtgggatggttttgggatttaagtggttctggttctggggacattggttatgcccatggtttcttagaagcttgaaccctcttcatcctcag

SEQ ID NO: 262244 - DNA, 375 bp, Homo sapiens
  misc_feature (51)..(51): n is a, c, g, or t
tgcatgaggcaggagccctgttaacattggctgtttccttctccccgaagngtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaat

SEQ ID NO: 262245 - DNA, 526 bp, Homo sapiens
gtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcc

SEQ ID NO: 262246 - DNA, 499 bp, Homo sapiens
gcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagt

SEQ ID NO: 262247 - DNA, 481 bp, Homo sapiens
atgcacttaacttttctggcctcatttctctcacctgtaaaaatgcaggtttcagatgttggtaatattttacctgtggttgaaagagttaccagcccttccttgatcacccatggtaagacccatgagcctctgaatataattatagaaaacatttggagagggatagagagagacaagatcatgcctcctttgataatgtcaaattttcagtgcacgaagccatacatagtgcagttttctagcttccctttcacacatggcattgaagaaagtaaattaagcaactcagctaacactgggaatgcagcagaagtaatcgagttcagtgctgggagacagttgccatgatattccaacatggacaccaggatcacagtcgatgactatgccctcccttgaagatggtggcttgcctctctttctgtaagcacatgtcatgtcataacaatattaaacaattgaaagtaatgtccccatc

SEQ ID NO: 262248 - DNA, 502 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgagcccagccctgaccctgcttgtgttgacgaggctgctggctgaggcgctgcccagccctgactga

SEQ ID NO: 262249 - DNA, 498 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccaggtaaccacgcgggtggtgggggcagcagcatcgcctcccgggcagcctggcccggcccctgggagcagggcgacgtgggtgctggggcaggtgtgcaggttgctggagacccaccaggcccaggcctgtgcctagtccaaagctcagccaacccgtgcagctggtggtatcactggagcttggcaccctcgcgcca

SEQ ID NO: 262250 - DNA, 661 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatgaattaaatccttgattaacccttatctccccagcgaggcgctatctccgccttggcgccgagtgtccagacacaccgtacaagatgattgatttcttcaagata

SEQ ID NO: 262251 - DNA, 507 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgcgaggcgctatctccgccttggcgccgagtgtccagacacaccgtacaagatgattgatttcttcaagata

SEQ ID NO: 262252 - DNA, 953 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatggtagggctgaggggctggcaccggcccaggagtcatccccacgggctgccctttgccctagctgcagtcacccctccctgtccgcctgcctccgcatttagtcctgctctggcctagggcacaggccatcctggggatacgggcacggggttagaaacgctcccaagtggggagataacgtctgggggcacaaggggagccaaggccagaggagccgctggggctctgtggggagcccggggaggaaggagcccccgctccactcttccctcctctgctttatctcctgcagaattaaatccttgattaacccttatctccccagcgaggcgctatctccgccttggcgccgagtgtccagacacaccgtacaagatgattgatttcttcaagata

SEQ ID NO: 262253 - DNA, 830 bp, Homo sapiens
ggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatggtagggctgaggggctggcaccggcccaggagtcatccccacgggctgccctttgccctagctgcagtcacccctccctgtccgcctgcctccgcatttagtcctgctctggcctagggcacaggccatcctggggatacgggcacggggttagaaacgctcccaagtggggagataacgtctgggggcacaaggggagccaaggccagaggagccgctggggctctgtggggagcccggggaggaaggagcccccgctccactcttccctcctctgctttatctcctgcagaattaaatccttgattaacccttatctccccagcgaggcgctatctccgccttggcgccgagtgtccagacacaccgtacaagatgattgatttcttcaagata

SEQ ID NO: 262254 - DNA, 407 bp, Homo sapiens
atcctaacaggtgtacagtgatagctcactgtggttttgatttgcagtttcctgatgactagtggtgttgagcaccttttcagaaacccattggccatatgtagctcttctttggaaaaatgtctactcaggccccttttccatttttaaatgggttatttttctcccattttgtagagactgccttttcgttttgctgtttcttttgctgtgcagagacttttcattttaatgtagtctcatttatgttgcttttgttgcctgtgtttttgctgtcataaaaaaatcactgccaagaccaatgtcaagaagcttttcttctatgttttctcctagcagtgttatagtttcaggttttatgtttagatctttaatccactttaagctgatttttttttgcatggtgt

SEQ ID NO: 262255 - DNA, 464 bp, Homo sapiens
tgcaaggagggtgttgggcaccagaaggccctggggaaagtgggagccgcagacagccaggcagctcttctatgtctggggtttgcaggagcactgccttccggggggggggggaggggaggcgggtgaggacagcacgtgacttcccctcctaatgttcatgtggtggggagtcaccctgggggcctcccgccaaattttagtatctctgtgattttagttgttgccccaagcagttaggacttgtgtagtttgaaagaaaaatctcacccagcataaaaagagaaaagggggaattgtaacaaatgttaatcataagcactgtttcaacccggaaaaatgtttgctgccaggctgtgggcaaagaggtggcctcggcggctggcagctcagtgggccttccaagtttactaagcagggtcttgtatttttaaataaaatagagcatcagacacgctcactta

SEQ ID NO: 262256 - DNA, 653 bp, Homo sapiens
tagatacctgcccctttagacctggttattattcaactgtcattgagaaaaatgcttgattatttggctatatacctctctacccctccttattgttgccatccaccatccttatttgttgaggactttgggacttggcttgtccaccctattccctggcataatcatgggcaactttaggggctgcaagggcatttatccaagttcctgtccttaaggttctttgacatgaagcatgccagcagtgacaatatgatattgtggttttgaatcccagttcccctacttcctaactatgtaagtttgaaaacagtgcttaaccttttgtgcctcattttcctcatttgcatattggggatgatactatctgcatatttggaattttgtgaagattaaatcagaaaataatgtaaattattttctattactaagtactagtgcatggcacataataaacattccataaatgttagctattaagattattatttatatatctatttaataatatctgctactattattattttagttatgtaacccctccaaaagctacctcttgagccttgctttctcaaattttaacctcttaaaatttaagagtcaaagggacactgaccatgatttcctagtgtgtacaatgtacttgctta

SEQ ID NO: 262257 - DNA, 289 bp, Homo sapiens
caagatggagacacaggctcaagatggggccagtggcagggtccactcctacaaacttgattggaagccacattcctctggctcataataaacattccataaatgttagctattaagattattatttatatatctatttaataatatctgctactattattattttagttatgtaacccctccaaaagctacctcttgagccttgctttctcaaattttaacctcttaaaatttaagagtcaaagggacactgaccatgatttcctagtgtgtacaatgtacttgctta

SEQ ID NO: 262258 - DNA, 334 bp, Homo sapiens
cttctcactatggaaaaagctaaggttttgttttggttttggttttttacaattatgtgaccttctgtatttacctttacagtaatattttccctttgattaaatagataactaagtattgtttcatagttacctgttatcctgttttatcaagggttcaaaccttttgcaatttttgatagtcttccccaaatcaaattctaaagtcttttaaaattttttttgttaaattttattttttaaaatttttatttatttatttatttatttatttgagattgcacccctgcactccagcctggatgacagagcaagactctgtctccacataaag

SEQ ID NO: 262259 - DNA, 199 bp, Homo sapiens
gcattttcactgcaggcagactcggttgccttggtgaagtccccgtgcatctgaagagtggctcatctgttcctgcctggggatcacttgtgctcatccaggcatggcccccaccagaaatctgggagaatggcgagctggtgccagctgaactgtgaacctctaagaataagtgaataaaacgattttatgcactaca

SEQ ID NO: 262260 - DNA, 423 bp, Homo sapiens
cctgtgtcttgaggtgggggaaagggaagtataaatgtttgccattaagaatttggtagtattctggtgatttattcattaacattgtgcggatgagggatggaaaaggtctagtttagccctcaccactctcccttttgtttctcattggagattttattacccaatcaatagattttacagaacactatttgcaggttttaactcatgtataaaaagaagccttcaacaaaaaccaagtgcgggtaacagcatatccttaataccagcatatccttaatactatacataatagctgatgtatagtagaagctcagtaggcatttcctaaaaaatatgactaaatcgggatacatttctgtagattccaagaaggttatgtaaaaatacaaaatatttttatgtttatctacatatatagtt

SEQ ID NO: 262261 - DNA, 497 bp, Homo sapiens
cccaccccaccatacgtagaaaaattgtcttccacgaaacaggtccctggtgccaaaaaggttggggaccactgctttaatgtattcatgttaactcattgccatgttttatactggttatagaaatgtaaaaaccttaaaatagtcaagacaactttgaaaaagaacaataaagttgatggactaacaccacctaatttgaagacttactagaaaacttcaaaatagtataatattgacaaaaaggtagacaaatagaagagtgggagagaatggcaagcccagaaataaacccagccatagacagactactaattttgagaaaggtacaaagggaacgtaatgcagaaaggacagtctttttaagaaatgctgctagaacaattggataaccatatgcaaaaaagaacttcatacttgatatgatattttaaaaaattaactcaaaaaagaacatagacttgaatgtaaaactgaaaatagaaaactcctagaaa

SEQ ID NO: 262262 - DNA, 453 bp, Homo sapiens
aagattcctctttcattatagtccaaactctattaatgcatgtctggattattctaacaaaagttcttatttgcttccctgactgggcctcaagatcaattttcctaaggcacctttctgatcatggcctacactcctctaaaaaagtccaatcgaacctactatgtatcgtcaatctgacaacccatgcctccctccccaactcaatctcctattgtttcacctcccaactcaaagccaaatgagaactttctaccgtccactgcattttccttcctctttagttgtgctatgacatacccttcccccagaagcctgacctccctcccttagaatggctcatacaaaaccaaggatctattcaaacacctactccataaaatagttcccaaagtagtaaaagcactgctccctctggaagggaaaatctaaaacacaggatacagaaatgga

SEQ ID NO: 262263 - DNA, 420 bp, Homo sapiens
aacataaacactatgaacgcttccaatttccaggcgagaaacaagttccaagcggtgaagcaatttgttcaagatcctatatagctcaccagtgacagcaccagggcctgagcccaggctgttgagccaagagccagagctgaaaaaatggagagatccccctggctgtgagattccaaatgtggcaggtcttcagggtttccttctgatttgtagtcctgcagcccacaccacaggggctgtggtgaatagacggaaaataccgagcctcctaattgatgtgaagccttttgaaaatgtctccgtgtccctccaaaatgaggagtgcctactcctcatgctgcttcagaacttctttatcttttaaccatttttcccttcaaatttaactctgctgacttctgcactgaggattaccta

SEQ ID NO: 262264 - DNA, 490 bp, Homo sapiens
gctgtgagagattgatatccagaaaaaaacattgtttctatcacattggtagcttaaaatcagccatggtgggtgtcttcataccacaaaaatttgcagatgctacaaaccaggcctttccttgtttcgagagctggttgttaaacgtttaccagaatgctactggtagtccaggctctcccacagctttacagtgaagaaccaaggtcctgtcgtcattaatattccctgtatttcatctaattgtttacttaaggattctttagctccttaattggagttaaagatttgttttccagacatgcctttaaagacatgaatttacagatagattcctaaacacataacctctccctgaaacgaaatatgtccttagtgaaaatgatatccccctaaagggtgtatgttcatgagaagaaaattagcccaagtgaaaaaaagccacagtcaggaataggaagggcaaactggaaaagaaaaaagaaaaaaa

SEQ ID NO: 262265 - DNA, 545 bp, Homo sapiens
tctgttaacattttgtatgtctttgtaattcttttcctactattttaacataattgatcccaaactaaatataatttgcactactcttattagctaaatatatgacaaaggcgtttccttatatttttaaaattcatcataaacattgtttttgttgattgcatactattactatttcaacttttttcacgtacaaaatgaataaactataccctagcagctaagcatttcattttcttacagtatttttatttttcaaaatgctgatatcattattttttgtccataataatttttgtccataatatttttggatcttttaagtatctttaaattttaaaacagttttaagatttttatcattgaaagaatatcgttggccaggcatggtggctcatgcctgtaatcccagctctttgggaggccaaggtaggaggatcaattgagcccaggaggttgaggctgcaatgagccatgttcttaccactgcacactacgctccagtctgggtgacagaatgagaccctatctccaaaaaaaagaaa

SEQ ID NO: 262266 - DNA, 387 bp, Homo sapiens
attattttacaactttatacaaatctacctgaaacttgtgtaccacattggaggaattgtagcaggcgtcttcagagctgacctctgcactctgtgacaccgagaatgccgaggaggctttcccgagtattcatctttagactatgagtagatccacagctccgaaaggtcctatgaaggtcactgaagaggtggtgaattcagggggaccgatcctgctggaaacttccatccctgcaccccacctgcccaaggtggctgaagcataagcacaaaggggcacctgagggatggacaggggcaccacgggacggtgctgatgtgggacttcaccgtgcagggtcacggttacggaggtgtgaaacctttccctgatgtaattttctc

SEQ ID NO: 262267 - DNA, 544 bp, Homo sapiens
caagtaattctgtaaagcatcagttttctcatctgtgaagtatgaaaaattatacctattttctgggttgtgaagatgaatgaacataatctagggaaaacatttagcgcatatgccactgaattaaagagaagcagcttaaatttaaagacaagccttaagcaggaaagaagaatacagtataaatttattatcctaactttttgaataataagcaaatgaaagatagttcaactcagctaatggctgaggtgtttaacctttcatcccttcctaattttgtgagattccttgttctaatttaggaaaagaaatcaactgtcagtttttaattaggtcctgagagactggaaaggaaaatggcaggctaagtcagtctagaagaaggagtctcctatttctttttagtgagtcagctggtcaagttgtgtgttgagcagtgggttaacttagggaaggtgggagttggaggtctgagttctttatttcacctcctattcagtcaactgtgtgaggaatcacttccccttcacttcttagtaga

SEQ ID NO: 262268 - DNA, 396 bp, Homo sapiens
agagctttgtgctgaacatcagtcctccacatcgactcctcttgtaagatgttgtgtccaggtggatcatcacagtggctgccatccttaaatatgtcttggtcctgttgctgctaattgatgtgagcttgtcgccatgtgtcctttaaagcatttaaagttttttttagaaacaaggaagacttttataacacccttcacattttataatattcctatttaaaacttgctccttaaggagcttttggaagcttctttaaaactctgcttggccgggcacggtaactcatgcctgtaatgccagcacttggggaggctgaggcaggtggatcacttgaggttaggagtttagaccagcttggccaacattgtgaaaccccgtctctactaaaaaaa

SEQ ID NO: 262269 - DNA, 298 bp, Homo sapiens
gattgtcaatgaacttttaaaagtaattctcatatttggtaataaaccatggatttaaaatttcatgtttaaactttataatggagtcacatttgatacattattaacattgccaaacatgctgtgtaattattttactgtctctccctaacccctcctccaatagaatgtgagctccaggatgaaggctttctctgttctgtttacaacagtatgctcaatctccagagtggtgctggcactaagtaaatattcattaaatatttgctgaatgaataaatgtaacttggtctcaaaa

SEQ ID NO: 262270 - DNA, 206 bp, Homo sapiens
gagtaaagtttggcaattctcactgatgctttgcaatagacatgtctattacatgtcaattacatttcctagccatgtctgggggccacagaactggcaaagaatcgtcagcgctcagaggaatttctacctggacttggaactatgaagccacccccttgtttttgtctagcccccaacctggggagacaccaggtcatggttgt

SEQ ID NO: 262271 - DNA, 300 bp, Homo sapiens
ggcctggtgacaactacagaaagacaataccttcaactcaaaaagagcaagagagtagaactacaatcaaatagcattgatttagatggaaaaatacgtctttgggatcatgcagaggtgggaagaaccaatgtttaggctgatagcagcttgtctaacattcccaagaaaatcaactttcaagccaagagaggaagtttggcatcaaaggacatcaacagtttccaccccgggaccagcagacagcaggatttgttaagccttaatgatatcatttgtgctttgggcacacacaatttt

SEQ ID NO: 262272 - DNA, 384 bp, Homo sapiens
tttgaattgtgctatcaatagttacttgatatggataataatgttagcaaaagcttaccaatagtgttagcaatagctttaaaaaaaaactcatcaaaaacaattatatctaagttagactatttcatttataaaagaagctacttttttttttttttttttttttttttgagatggagtctcactctgttgcccaggctggagtgcggtggcatgatctcggctcattgcaacctctgcctcccaggttcaaatggttctcctgcctaagcctcccgagtggctgggagtataggcacctgccatcatacctggctaatttttgtattttttagtgaagatggggtttcaccatgttggccagactggtcttgaactcctgac

SEQ ID NO: 262273 - DNA, 455 bp, Homo sapiens
ctctctaagatgaggggagttaagatttcatccagttagagctgtctctcagtgtcattgtaaaaccgaagactttgggcttaactttctaagtctcttcgagttctcatggtttggggctgtagagtaatgcaggtcctagccattctgctctgctctgacatccttccacctcttaaatgagtagtttttaaagtccagattgaagaatacatgacaggttgaaaactggtgactttagggaaatggcttcagaaagaagtgaggcagaagtcattggtgatcttactgagtgttggcaagagcaaaatttagacacaaaaaaactgggctttggctggatgtggtggctcatgcctgtaatcccagcacattgggaggccaaggctggtggatcacctgaggtcaggagttggagactagcctggccaacatggtgaaaccccgtctctact

SEQ ID NO: 262274 - DNA, 515 bp, Homo sapiens
aaaatccgtgctgctgggtggaacgcgggtgctgttcacattcgtgtgtggttttccctggcttatatgcaacagcttctttttctcttttcttaatttaaaggtgactcttctggaagtccccaaagtggaattgaccctaaattgaaaagaagatctttctagggcaagagctttgttcttgtgaattttctgcctcaccaaccatggggaatgtgagctgggggggaaaagtctgttaaagctggtcattcatttcagggggccaaggagcgattctgaaggagcaaagtctcctcatgctcttggccttttgatctactcaggctctgtggcaggaagacagggaggaatccctgatcacccacagccctccccgctgctgttaaggcagtatgatgatggggggtggagctggaattaaaaataaagaaatacaagcttgaattctactttaacatgaacaatctctaattttcatatcataaaatgaataaaataatattttttcccat

SEQ ID NO: 262275 - DNA, 506 bp, Homo sapiens
tggttctactaagctcagtggttcatgaccaggaaaagatgcagccctgagttgagtgaatatgctgtgccaataccctaagtccctaaaacagaatgtagacaggaaaagagaaatgcttttctgcaaatagcggcgcgtctgcagttgtcacctaacttctcgtcatcgtcatgttccctgagagagaagaggaaagaatcagaggagaatgcatgcctggggagggaagagaaaatacaagttacaggaaagaagaatatttaggcggtgctgggttccttagctgctaccaaattgatattatagacccttgaataaagtggtggaaattcagtcttctctgttcttcatcccccaaacttaatcagccgatcagtgccagtgtagggcatgtgtggacgtgtttgggggtgaggggcttgtgcatggtatatggggtcctcttacttttctaaacaaaattattcccttctaattttttccttccatctgaagaaagcaat

SEQ ID NO: 262276 - DNA, 622 bp, Homo sapiens
cacgatattcagacttgaatggcagcaccaacttttccctgggtcttcagctccatgaccttcagacttgaacggcagcactggctcctcccctctccagctccatgaccttcagacttgaacggcagcgccggctcctccctgggtctcgaacctgcccagcctgcagattttggacttgctagccttcaggatcacattagccaattccttaaactcaacctctttctctgtatgtaggatatggacacctcctgctggctctttttccggagagcccagtgaacacaccgtgcatcaggctccatcattcaccagagcgtctttccaacagactttgctgtgatatttcttaaataaaggtcactccaaagaccctcacctctggattgtaaccaactcagtggcagacttaatccatttctatctgctgacatttctcacatggaataggctgtttgacagattgaagctgtctccccccactccccaggccagtgcacacttatctcccttgaatgttcattttgtgctcattttagagactgaggcacaaagacaggcaaatacaaggtgaagtcagtgacaaataaacaatgctatttaggcattgagagtttgt

SEQ ID NO: 262277 - DNA, 550 bp, Homo sapiens
cagacatgtagaccactagaacagaatagagagcccagaaataaagccaaacacctacaaccatctgaactttgacaaacgtcataaaaacaagcaatggagaagggagtccccattggccctgggataactagctagctacatggagaagattgaaactataccccttccttataccacatacaaaaatcaactcaagatggattaaatacttcagtgtaaaacctaaaactgtaaaaaattaaaacctaaaactgtaaaaactaataaaatccttaggaaataccaatttggacgtatgccctggcaaagatttcatgatgaagatgcccaaagcaattgcaataaaaaaaaattgacaaatgtgacctaattagactaaagaacttctgtacagcaaaagaaactgtcaacagagtcaacagacaacttactgaatgggagaaaatatttgcaaactatgcattcaacaaaggtctaatatccacagtctataaggaacttaaaaagatttacaaacaaaaagtaacctcattaaaaaatggacaaa

SEQ ID NO: 262278 - DNA, 399 bp, Homo sapiens
gttacatagattttagctggataaaaaataaggatgaatactttatggaaaggaaatcatataaaagtctgagaagttaggggaaatagcttcttttgatgaacagaatgaagtctatggtatgactaaaacagcacaagcaagggtaaagggctgagagctgctgctggagaagtaagcaaggaccaggcacagaacctcaaaaagcatgttaatgaaactggatgtgacgccaagggccagttaagcatatgataaagaaagctaatttagaaagaaaactaatagtatatttcaaaatactccattcattgaatgggcattcagtgagtttttgttgactattatgcctacccatttaaaaggagaattattcatacattaaattctgtgaaaata

SEQ ID NO: 262279 - DNA, 418 bp, Homo sapiens
gccactgcacccggcctgattccataatttttctcaattgtttcctctgagtaggatctcattttctctgtcatttgctttcctacatattaaagctccctcatttttttttttaatttatttacttttattattttttagtagagatggggtcttgctctgttacccaggctagagtgcagtgcttcaatcacacctcactgcagcctcaaacccctgagctctaatgatcctcccgcctcagcctctagagtaactgggactacaggcatatcaccacgcccagctagcttccttgttcttccattgttactggaaaggggtcctgatccagaccccaacagagggttcttcaaccttgtgcaagaaagaatttggggcaagtccatagagtaaagtgaaagcaagtttatgaaga

SEQ ID NO: 262280 - DNA, 693 bp, Homo sapiens
gtctcctttaattttcggtctatttaagaatgaaagatggaaaggaggtgagtggggcacaatgaaaatacaaaagcgagcatattctcttcccaaatctgggttctttagtacgggggcaaatgtcccactgcctcaggacactctggagttgagaagaaagtgttttgaacattgtgctttaaacaatctttttaagaaagcgaggaaatgtataattcattttgcagtcttgcagaagtggttaatgtggctgattttgtcactcagctgcatttctctggaaaaggcgtttatgtggcatggtttgttcactaatgatgctaagtgaataagctgtttctgaattatgggtgccagcagtacatgtgccaggtgaggcagttcttacttgtatttgtcataaactgatacctgccaagctgcactcaggcccttggggctgtagctttgctggcatccatcgtaccccaggcctctgaatggctggcagttggtacccacccacatcccctcaggaccattggtcaaggctctgcctcccctgctgttagctgcttccctttgcttgaggacttgctcaggctgccagagcctgctctgctcagcccagaagtacctgagaagtaacagccgtagaagccctccaccagtgactgactggagttggtggataaataccccagctccctc

SEQ ID NO: 262281 - DNA, 510 bp, Homo sapiens
tgcccgccaccacacctggctaatttttgtatttttagtagagagggggttttgccatgttggtctcaaactcctgaccttaggtgatctgcccgccttggcttcccaaagtgctggaaatacaggcgtgagccactgcgcctggctgagttttacttatttattactctgctttttaatttatttaactgtaagtttatatatcttaatttttaaatgatgaaggtggtaataactggcttgcaaaattcctgaaaacttaagagtcctcatgagctagtcttcactggctccagcatctgggagcaccacaatactttacctaaaatcattatggctggatgttagaatactgagttgttcagattttaggcaggtaatatggaatatgtgtcataagatgtaacacctcctgtgatgtctgaggcaggaccctgtagtcaaaattttggtatttctgtagcaaaatgtgaatattcaccaagtaaataaatactacaaataatcttg

SEQ ID NO: 262282 - DNA, 504 bp, Homo sapiens
tctattttcttactatgtatcgcaattttataaaagaaaaatagttgtcatgaaggaagaggtgttacaatcctgggtaaaagggccagggcaggagcatggacaagccacaggctctgggcacctctggaataaaatctcacttcagcttaaaataccaaacgtatactgtgaccagcaatttcaatatggtgaccaactgacatgcccttcgaacgccaagaagacaacagccccagaaacagcttcagtcaggagacccagggtgctggcccggttctgccgccggccggctgtggaacaggcttctggagcccgagggtgacgccccagcctctaagagcaggtgcttgagaacaacaggggctgcctcatggggtggcctgtggttcagtctcaaaagcagcaaaggaatcaatgaactgtgagacgctgatcgttactcactccacagattactgtggtgacactatgtgcaaaaccaggaggccagccatgctttta

SEQ ID NO: 262283 - DNA, 439 bp, Homo sapiens
tctacctcccaggttcaagcgattctcctgtctcagcctcccgagtagctgggattacaggcacacactaccacgccttgctagttttcttgtatttttagtagagatgggatttcaccatgttggccaggctggtctcgaactcctgacctcaggtgatccacccgccttggcctcccaaagtggtgggattacaggtgtgaggcaccgcaccctgcctgtattaaatatatttaaaaggtaagggcattctgtatgacattactagaatacctctgcagtttgtacccaactttacattcttttacattttgctcattacctgtcaggagaaaaccctccttccccagtctccactgtccatcatgatgatttcccccatcaaatgaaaataattaagatacttttaaaagctgaaaatgcaacaacattccaaaat

SEQ ID NO: 262284 - DNA, 303 bp, Homo sapiens
ggttgatcctgttttctagctctatttccagagcctgtgtttggagctcatcaaggtagaggattcttttgcttccctgttccagcttcagccagtgacaccaggatttagattccagcacccccatgaaatatagttgccgttgcctctcatctcctgcctcctttttaaaaaactgcttcactgagatataatccacagaccatacaattcagtggcttttttcgtatatttacatagctgtgcagcctgggcaacagagcaagcctccatctcaaaaaaaaatagaatgctacgtttacc

SEQ ID NO: 262285 - DNA, 257 bp, Homo sapiens
gccgcggctttctgctcccgccgccgcggctctgagggcgggagcggcagactccgctgccagctctactggcgtcctggcaagggcagcgccgaggggcgctcccggtccagctctcccggctcgggggttccttgcctaggcgcccgagccccgggctccctgcctcggccgctgtggcctgcatagggcggcactgcgcgcggaggcgatgggagagaagaaggagggcggtggcgggggtgatgcagcggccg

SEQ ID NO: 262286 - DNA, 405 bp, Homo sapiens
ggaaacaccagtgaagagtgcacacaaaggaaagaacttgtgagaacacagtgagaaggtggctatcctgcaagccaaagacagaggcctcaggagagaccaatgcatctggcaccgtcatcttggacttacagcctttagaactgtgagaaagaaaatttctgttatttaagccacccattctgtggtatttcgttatgtcagcctaagcaaaaactactgtaatacagaaacctgtgacatacttatgttagtaaaaatgtacaaattgtttgtagcaagagaatttggttaaatggctgatgtaaggtcctctgagctggcctcaccatggtcaagccatggtgacattccctacccttgtgataatatactttgtgatattccttgtgaatgtactttgta

SEQ ID NO: 262287 - DNA, 417 bp, Homo sapiens
cacctcccaggttcaaataattctcttgcctcagcctccggagtagctgggattacaggcacccaccaccatgcccggctaatttttttgtatatttagtagagagagggtttcaccacgttggccaggctggtcttgaactcccgacctccagtgatctgcctgcctcagcctgtgaaactgctgggattacaggcataagccactgcgcctggcctgttaattattctttaaaaagaatatatgttatgtgatcttgactatgtaatttatacatacacatactaaggcctgtatgttaataaagggagcttgagaaagtgagacaagcatgaatcttattttccaagcagcagaaatcctctctcaggaaatatttcctcttgctagacgtttatcttgatgagccttagggtg

SEQ ID NO: 262288 - DNA, 386 bp, Homo sapiens
ataaagcacctggcacataaaaggcagtccttcattgtttgccactgttattattattgttgttgctaggaacagtaatacttatttagatttttttcctattaaccttgacagtggaagctgcaagggaggaaccataccttgtttatccagtgagctttccctgaggcaagtaaagcatgctgcatgtggtttaattatgctgttccacaaaatcataaaaaatgtaataggttttaagaagcattaataacaacttagagttttcagtcactttccttctctcccagaaccaatgagaggttctcaccatgtttgccaggttcaaaggagagggcttactgacatttgccttgttgaattcaactggattcaagttctgactc

SEQ ID NO: 262289 - DNA, 422 bp, Homo sapiens
agcatcctttcaaaatttcattttctatttgatgctaaagtataaaatttataattttgaattttaatattaatgcttacatctagtaacattgtaaattttcttattattgcaaatactgtatccataaacttttaaaatttttctagatacatgatgtaatctacttttaagaacacttatttcttttttttcaagttttccaatccttatacttattactacttttctttttatttaccgtgctggatagtatccctggcacaatactgactatgtcattagttttcattgattctatgctagtcttttttatgctgaaaacttcctaaaacaaagagtgtgtgtatttactaatctctgtattgacagaagccccatgaaaactcaataaatatttgttgaaagagtaaagctatcaa

SEQ ID NO: 262290 - DNA, 263 bp, Homo sapiens
atgtagagtattccttaataaagcggttttttttttctttttaaaaaataacctgcaattttttattctgtctcaaaaaaaaaaaaaaaaaagaatatggaagttataaaaataatctgtgatcatataatgactgttttccccaaaaagggcattactttcctgcttcaaagtatgtatttcttaactaaagtgtttgtgggatatggctgcgtgttggcatcacctagagaacttaaaaaaaaaaaatgaaaacaaaaaca

SEQ ID NO: 262291 - DNA, 611 bp, Homo sapiens
gccatcaaaggtacttgtttataaggcagtaagaccattatgcaactttaaattttatcccactctgtttgtaaagacaatcacaaattgacaatattctttgtcttttcttttttggagcatatatacagaagcacacacacatatacatattcgtgtgtatgtatatgtatatctgtaaacacagatatgtaaagtgactttaaaatacaagtacatgtgtttcattttaaattctagcgatgtcattgggaaagaaagtgtagacaaagttacatatttttgtaagtagtgtacttttatttacgttgacagttaatatttaaaaattttttgttacagatacaaattttggggagaattgtccttagaaacatgttttaaatcgttgttctgatgtcttgataactggtaccaggaaaataaaagggttaccaaaaggcagaaaccagtttcaaattatctgggaaataaaaacaggaaactcagggaacttggcctgagaccagttggagaggagcagttgttggttgaataattatacctgcattttaactgttggaagtcatacagcgaccttctggttgttgtgatttcttgtgcccgtcaaa

SEQ ID NO: 262292 - DNA, 228 bp, Homo sapiens
ccagagtcccgttaggtgtgtttagcctgaatactccttacctgtaatgtttccttttagtaattttccacccactgactgccaccctgctccttggttataaactcccacttgcccaggcagtattcagagttgagcccaatctctgtctctcacccactccaagaccccgttgagcggtccctatgcccatccacatggtcctgaataaagtcttccttactgtgc

SEQ ID NO: 262293 - DNA, 1463 bp, Homo sapiens
gaactaaagttatcacattgtcctatccccctccttccagctacctgtcaaaatcgtgatatagtcagataatgaaatattatacagcaggtaaagtaaccaaaccagagtatacttatcagcaggtataattgccaagaatagaatgataagcaagtgctaaaagcaaattccaggtacaagatggcatttatattataaaacttaaaaaatgcaaaacaatatgttgtttctgaatacaggcatttacagtaaaggtataaaacatgcatggaaagcaagtttatgataaaggccacttactagtggagagaatgaaagacattggatttgagaggcctctgcaaggagtttcacgtatatcattaatgtgatagtgtgtatatgggtgtttatattatagccactatatttttggtattcttgaaatattttatgtaaaatactcagtgattgttttgaagtaggattcaaattgctttaaccaagtatttatgtagatttttaagtaatttgaataacaatgatgtaaacattctcacacctgtgtttgtgtgtgtgtgtgtgtgtgtgtgtgtgtgtatttggttaaatttgtctcataatgaagattgctccaatataaatatgatttgacaataactgcaatatctacagtggcagacaccaattggttcttcccagaacatcatagaaaaaattatgatgataaattgtgataatcttgaaatgttttagtatatactacctcaagccaggggatgaagcaaaggagataatagcattcatgacggtatattattacacttagcttcagaactagatttgttgccttagatttttatcccactttatccctcaaagagttgagactctgaatgcctgttctttgtgttcagcaaggtgcccagtataataactacatagtgcggacatttgtggagtctgtacaaatctgtctccccctcctagattgggagcctccaagcagtggacctgccgtgttctcttaggttctgtcactgtgcctgctccctgagcacaagtggtgatgccatggctggatggctggtgccagatccttcatggtttcaattcagtgtggaacacatcaaccttctgcatgttgtttgatttagatttttctaataacgaatttgtactgtctgtatttatgaaagtgccattattgttgtggtactttttttcacccatattttgaatgtaagtcctgaaattacatttgtaagtggaaaaattcacagggaagtgtttgttttcaggcaaggaaggtgcaaaaagtggaaaagcccaagatgtgagtccaagatgattaggagcaaaaccaaggtgtccctggcagccactatttatttttaaaggacccctttgtgttttgttaattgcctaaataaacagctctccaggacagagaggcttcttttttcatggaattccctaga

SEQ ID NO: 262294 - DNA, 659 bp, Homo sapiens
cccttctccagccttcccctcctcaattcgacccatttcttccctacttcccaaaagaaaaaatatctactttggattaatataaatcagtttaatctaacttattcaagacttttttggcctctacttggaggttcaagaaaaggtgtgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccctgtgacccccactctgtccgccagagaacaacacccctttgactgtaattttcctttatctacccaaatcctataaaacagccgcacccttatcttccttcgctgactctctttttggactcagcccgcctgcacccaggtgaaataaacagccatgttgctcacacaaagcctgtttggtggtctcttcacacgcacgagcatgaaagtgaggtgatacaacgagggggaaaagaattattattattattattaaggctaacctacaaatattttgaggtattttatgggtttaaatatccata

SEQ ID NO: 262295 - DNA, 524 bp, Homo sapiens
gcttatgggatgagctacgtttcccatagaaggggcagtagtgagggttttcttatctgaagcaaaatctctgacagatgatgagaaatgcagttttatgtcattttttttctgataagaattctattttttttttctgagtgactgtaatgggccttccatttattttagacaaaaaagacagaattagcattttaggctcagatgatagttattagaaagtttgagatgggccaaagtgcagggcaacagacggcaagggaaaagaggagcatagctggtgcatttgatgctggtaggttggagggagggaggaggtcagagttatgaaggcggccagggaaggcttcctcggaacctgaagaaagggagacagcaactgcagggaaggatctgtgggccctaatggccacgtcacactacaaaggcccggactttgtccaactcgcttctgtgctccatgagtgcacctgtgtctgaggcacatcagctctaagccagtgttctctagtgatggagtgaat

SEQ ID NO: 262296 - DNA, 436 bp, Homo sapiens
tcctctctgtaacacagcctgtagaatccaggaggaaagcgtccctagtctatctgaagtagctatcaaaagactctggtctaaagccatgcattttactttttagtttctcactcagagccttatcacttttattaaacttccagtccttaacaccactgagagtctgttttcccagcccggacagagaccaccaggtagaaagggacagagttgggttatttttagaagcagctacagttacaacagaagtggcaactggacatggagaggtgacagaatatcagaaaaatagaaggtaaaataatggatgttcaaaattttgaaatgctgaagtcatggaacaagattatgctttcccccagtattctctgtaatagaagtcacagaaatatgtgatacattttaataaagatttttatgcaaaatgaaaaaa

SEQ ID NO: 262297 - DNA, 368 bp, Homo sapiens
tcttattgatttgtgttagttccttgtacattccagaatgtaatatacaatgtgaattaaaaatacctatagactagagtttacaacaaaatgtataaatatatggatatatgtgaaaaaggcggtctatggaaacaagagaattgtgaatagaaaatacagataaaaaggaatatataataaaacacaggaattttgcagcctgaataaaaaactcctatgcaactgaggcccttaaaaatccattacttgggctgggtgtggtggttcacacttgtaatcccaacactttgggagaccaaagtaggtggatcactgagtccacgagttcgaaaacagcctgggcaacacagtggcctcatctctac

SEQ ID NO: 262298 - DNA, 504 bp, Homo sapiens
ccatatcagtagcctaaccttatgcagtaataactgattcagacttcatttataaaacggaagggaaaaatgcaagaataaaaaggaagagaattcacagcagagcaaagagaaattactgccatatgaactctaacactgtagcattctttcacggtctggtactttttaatcttgagtcatagatggaaaaataaaggaaaaaaattgaggcacaaccattctacagtaggcaaggcaattgagattgcttggattcattactctgaactccagcaaacagctacagaatgcctagaattccccagacatgactattacagctctctgtggtggctcaacagacttcgttttcagataggttatttggagcaccaattttctttctaaaaatctttgttttggccttgatttggaaataacctatgaccgtagtatttatttttctgcttaagaattcatagagaattttggtttgggcagcatgacaacttttacttaata

SEQ ID NO: 262299 - DNA, 447 bp, Homo sapiens
catgcttaaaattaaaaaaactaagagaatgtaagttccaaatgagtgtcacatgactataattgatagtaaatcttcacttacctccataacttaggagtcatgaaaagaaagaagttagcagaccaggcatgtaaatcagatgtaagtaggatggaataccagaaatattcctagttctgggtaacccaatttgaggtcattttaagtttactgaatttggattaatcaattggttcaataatcaaggtaaaatggtccaaaagatcctgatatatccagaagacatattactgaggttttacaaggctaatttgaaatgcagattaacattctaggtttccttacatatcattaaaatagaccatattaaaaatcaatttcagaagctgctttatgactggaataaaaaacaattaaagatgtagagtaacattgtatttctgt

SEQ ID NO: 262300 - DNA, 638 bp, Homo sapiens
aacatttgttcgtcacctactatgtgctaggctctggggagaaacaaaaacaaatgaaacaagaatcaccaagactcaagaagcttacaacgaacggcgaataaaaaggctagaaaaccactggcttcgggaatctgtggtaagtgctattcaaaatgggtgtccaggccaggcgcggtggctcacgcctgtaatcccagcactttgggaggctgaggcggatggatcatttgaggttaggggtttgagaccagcctggccaacatggtgaaaccccacctctactaaaaatagaaaaattagctgggcgtagtggcgggcgcctgtactccgagctactcgggaggctgaggcaggagaatcgcttgaacccaggaggtggagggtgcagtgagccgagattgcaccactgcactccagcctgggcgacagagcaagactccgctcaaaaacaaaacaaaacaaaaagtgtgtccaaaggaagggcctctaaatcagatttctcatggggcattagaaatatagaattttgtttttgccatatttttcatacaatcttagcttaataacaaatctgaataagctataaactagataacaaggccttgaataattccattttcttaactttaagttga

SEQ ID NO: 262301 - DNA, 308 bp, Homo sapiens
tttgacagtggtgaactttgatctacagtcccactttacagaatcattttcacaaaaacattttgtgtgatcctttcatctcattaagcacccccccaaaaaatccacatacgggacatttaatgccattgctgtaagctgtgtgtttagtataccatttaagtacttttaaaaatgtttgaaactcaatttatttattatatttgcatgccaaattgtgctatccaaaaacatggacctcagatcatgtagacataaatgaatgaatgaatgaatgaatgaatgaatgaataaaattttatcttcta

SEQ ID NO: 262302 - DNA, 306 bp, Homo sapiens
gagggggctggggtgggtgaggcacagacacttgctgccagagcatgtgtaaccagcagtcctttgttcaccatacctgcttcaatcattgttaggaaacctaacaatgtctattacagcaatgccatcataaatgtctgaatcaacgtggctgaaagaaacaccactaagattgaactgaagactcctagaagaaaacagataacagcagaaatagccctgagagatcaaattgctttttattccatggacatcatgatttgacacagaaaggttagaaaatacaaatatatatcactgagttca

SEQ ID NO: 262303 - DNA, 478 bp, Homo sapiens
tttctcatagataattcttaacagaataaaagctacaggttgaaaccaattccctttaaaatgtggacagttgaccatctccatgataggtagttaggcactgaattaatgctttttaatggaagagccaccctaagattcctggagtgtggtataatggagtactaaatcagcataggactaataactgcctcctgtgtaaactggtctatccggagagtggtatagcctctcatacagtgttcaaaggcagatttaactcactgcaggtccacagcaaccgataagataaactcgttggttatggtctcccactttgcaaaggagagcacagaggaagaggaaactgagataacttggtttaggaccccacagctggctggagctgggctgaacattagttcattgtttcttcgattaatctatgctgctttttctctacttggctccttttctaaattaaacaaaacaaaacaaa

SEQ ID NO: 262304 - DNA, 219 bp, Homo sapiens
acatatgaattttgagggtgaggaggacaagcacattcagaccatagcaattgccttaataaagtaggagctccctaagtacccctggctttaggcatgtttgtaactaaaggttgacacaacatccatttctttctgctctttgacctcattttctctatgtgggctttcttctccagcagaacgaccctaccgactgcagaggtggctctagcagca

SEQ ID NO: 262305 - DNA, 445 bp, Homo sapiens
ataagaagataggtattttctgtatctagccaggtgagaccacacatttagagttataagacagattgacaagatcagaactacaattacaagctatccacaaactgttgcagaggcagacaatgttttctggatgctttccttagcctgagtttctgaacctactactatatgaaggagtactgccaagacctagccaaaaaacaaaaacaaaaaaggccctggtggcttcaaagattttgacattgaaaacttgtcccagtacctgaaacatacaatgtcatgtgtcagcaagctcagcctggagcccacaccttggccatctgcccagaattctcaccccagttctctaaaactctactctttcttctcgggtggactactttttgatcccaaagggcaatgttaatggggctttgatgcaactgagacatagtccaaaaaa

SEQ ID NO: 262306 - DNA, 403 bp, Homo sapiens
agatacctattttgccccaggatgaggagaggtaagggggatattcctgggtgccctgttgcctgctgagaatacaaacaagtaagcccttctgcacagttcacatgcagcttttcagatatgggttttgtttgtaacttagatatgcacattaaaagacagatctgggaaatctatgatgtaaatgtaacaaatatgacttgattttttctgatgactccagtgttagctgcctgccagaccttttcagctacttagtggcagacatatcatcagcattgaaatctgtctgactccaggtccagtccttaaacattataccaggttttgggttatttacaatcataaatttcattgaatttctttttacagatttcaaactgtataggttgtagagggtcag

SEQ ID NO: 262307 - DNA, 289 bp, Homo sapiens
gaccagttgtctgctctcgaactctgtttcctgttaagatgtttatcaagacaatgcatgcacagcgggacacagactctcatcagtaattctaattttgcccttgccttgtgatcttttattgccctttgaagcatgtgatccttgtgacctactccctgttcgtacatcccctccccttttaaaatccctaataaaaacttgctggttttgtggcttggggttgccatcacagtcctaccaatatgcgatgacacccccggaggcccagctgtaaaatttctctctt

SEQ ID NO: 262308 - DNA, 311 bp, Homo sapiens
ccagcaatagaaattaactctggatgattcaagtggaaaagaagtttgttgaaaggatattgagtagttcacagagtcatttggaacactagagaaaaggcttaaaaaatgggcaggcaggataaaacaaagtgcatagctttgaagctaaaattatgctgcagaacttgactagtgaggatattttttctgatgccagcaaatgctagatgaatggtttgtacctctcatttctctagcattggcattggcattgtttgctgctgacattggctactggatgacccccctgctataactgtgaccagatc

SEQ ID NO: 262309 - DNA, 313 bp, Homo sapiens
gaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccg

SEQ ID NO: 262310 - DNA, 398 bp, Homo sapiens
gtgtcaatacactattgacagcttgtcaaatccattcatgaagacagcaacagcgcgaagctgaccgagtccgcgggcttacctcgctccacaccaacatagttccgaatacaacttgcagcccgtcaaagaagttgtcgccaattatgatgacggtggcaccccccgtggtccagccttcactgggactgatggccttgatgcacggagtggctgctcacacaagacagagaaggcagaccttagagccccgtcctcctccgacgctgggccgctcggccaccgcgcgtcccgcggccaccgcgggaggagaggcgcgccgttcctccaggcggcacgcaaagggcaaccgtagatcagcatgttgatgtgtttaaagcaaactattaaatgtttta

SEQ ID NO: 262311 - DNA, 472 bp, Homo sapiens
aatccaagcatgctcagctattgctgctctttctaaaaaagcagtttattctctcaggtacctgtgattctcctgttaagttagtctcccctcatagcacctgtatttttcttcccatttaggatacaggtgtgtgtatgtggggtaggtttcagaagaaggctcatgtttactaggttgctatgaatatgaacctgatttattttacatgtgttttctcatttaatcttttttagcaatcctctgaggtgggtagaattatgcccattttaacataatgaaaataagcttcagagagagattaagtcactttttcacaactaggaagagacagaactgagattcaaatacaggattttctggattcccactgttttgcactgaggagaaaattttcagcttctatttgttaccagttgtaagcccttacgatgtgctccacataataaaaacctatgctatttctggcttt

SEQ ID NO: 262312 - DNA, 644 bp, Homo sapiens
gtggcgggtgcctgtagttccagctactcgggaggctgaggcaggagaatggtgtgaacccaggaggcagagcttgcagtgatccgagatcgcaccactgcactccagcctgggcgacacaacgagattccatctcaaaaaaaaagatagtgtaatattggcactgggtaggctaataatgatggaccaatagaacaccatatggagtccagaaacagtattatgcatagccagacacttgatttatgacctggaggcatggcagaaaggcaggcaaaacaataacacttttagaattaatataggaagatactcatgaccttagtatagagaaacatttcttaaacaagatgctacaggcactaatagaataatgggcaaaagtcttgaacagccacttcagaaaaggagaaatccaaatgtctaataaacatgaaaaggtgttcaaccatgttaatgaaggaaatgcacatttcagccacagtgccagaacactgtatacctaaattaaagttggatgttgaacagtagggactttcatagatggctggtacagatataaattcatatgactaccttggaaaacagtattatcaagaaagtccaaaacatgcatactttaatgaccagcagttccaatatta

SEQ ID NO: 262313 - DNA, 2189 bp, Homo sapiens
  misc_feature (1323)..(1323): n is a, c, g, or t
ctcaatgtagtatagaataccatacaacaccgtttttctgctttctttttattcctaaataaatcagatggggttgataatgttaggtgttcatgtcactgtgagtctggtgtgaactggcagttagaaggctagcagggtgaggaggacatctgcctataagggtgacccggcatgaggcagaacctgagcagagtaagggagagacccatgtgaccttggtggggtgtcattgtctgagcaagttgaggaggatgttcacgtggggtaggggctaagatgaagagttagagtctgagtagggtaagggggacatgcaaactggcttttgagtccttggatggggaataggtgatgacagagatggaaatctggctacatacagaggaattggttaaatagataaataaatatatgaaagacaatgggagttagtttcttactattgtaaaaagggttgtaaatatagcaaaggagaagagtagatgaaccatgaagattgggttcaacactactggtatgaactcatgatttttaatataaatagataaagatagataaaaaatatagttgtgtatttataaacactctgaacgtgtgtttttgtatgtgttatgtacatacacatatatatccacttgctctgtccactgagaagactttggagcagctattctccacaagaatggacccaagggttctttgagaaacactgctttcaggtctggagcaggggaagtttggtgggtctaggtcatcttgtggcaaaataaataactcagaccttcttggaggtgtttccactggctgaaccatgttatccttgcatattaaaataactatgattttaatagattataacccactgataaaacaagaaagcaggagtccatggtgatataattaacaagataattatatcacaggatatttaaatagtttagaagtatatcatcacaaaatattagttagaaaggaatttcacagtggagaaagatgggtggtaggtctcatgttaatctagtgatcaaagtgaatgccattatcaatgagacaaattaaaattatgtcccaattttaataccagaaatgtataagatcaggtaaatccagattggagaacattacaaaataactggcctatgattggcaaagcatcaaggtcctcaaagtcaaggagaaagtgaaaacctcttgcagcctaaaggggactagaaattcataaaagtaaacacaacacgtgaatctgaatgcttagatcactttgctataaggacactactaggacaactggagaaacttactgttgtctacagattaganaattttattagtgttaatttcctgatgttgatagttatatgattatataaaataatgtcctttttttgctggaaacagaaaatttgggattgagggacaatgggacatgatatcagcaatttattctcaagtggtttaggaaaataaaagattttgtgctgtacttctacattttttcttagtttatgattatttttaaaatattacaagaaatgcctcttgaattcagtgtaagaaagtgtgaacaaattacttaaaataaatttcagaagttattcctatcattttatctaatgattaattaatgcatctacaagtgttgtcttcatacaaattttattaagttatcctcttgtataaacctagaaagagcaaattggaaatgttcctcttgaatatttttagaactggcaagaatatttcttcaggtgatagagaatcagaactatctgaaattctctggaagcacatttttaaaaatgtttacatcacattttgattggccatattttaaataagaattctcattagtattcttattttctgatcataattgatcccactcttgattagttaatataattcttttaaacatcaactatttttctgtgctgtgataacaagtgatagcttcaggatatatatatatatatataggaatacaggacttttaatttattactaaatggtcctaagattcttattcttttcctccctccctttcccacacctttgcctctcctcgtcatcccccttcttttcctctcctactctctttttctcattcaggaataagaaaatgctaattattgctacaaatcttcaatactgtgctagaggactaaccccaaataataattttgatg

SEQ ID NO: 262314 - DNA, 191 bp, Homo sapiens
cctccaccctctaccccctgtcagcaacctgttcttcagggactgggtgccttgtcccagctctgctgcaacacactggctcaggaataggagataggaggaccctgccaccaacccccgcttcaccttccctaaataactcgtttgcaggctaattccatcaaatttatccctgccatcaggagagaaat

SEQ ID NO: 262315 - DNA, 424 bp, Homo sapiens
gtgaaaccctgtctctactaaaaatacaaaaaattagcccagcgtgtagtcccagctacttggaaggctgaggtgggagaattgcttgaacccaggagtggaggttgcagtcagctgagattgcacgattgcactccagcctgggcaacagggcgacactttgttctccgccccctaaaaaacccccaaaacaaactaaccccatttcctaggcatagtttcagtgccatgcctaggtagtggagagcaagcagctttcaacctgggctgcctggattagagcccatgttcttaaccacaagactaaatatccccccaacttgtgcttcttgtataaagtaatggctgtttcctgatttttttttttctgatatggagtctcattctgtcatccagactggagggcagtggtgtgatctgcaac

SEQ ID NO: 262316 - DNA, 514 bp, Homo sapiens
gagtgacagctaaacaggtatgaggtttttttcagtcggaacaaaaatgttcagttagattgtgatggttgcactatcctgtgaatttataaaacacgttgaattttacactttaaattggtgaattgcatggtatgtgaatatctcaataaagctgcttttttttttaaataactagaatacaaagaaagcagggaaattcttgctgaggagaaatactaatgtgattatttgtcttgttaatgaatttcatgtcctcgttcgggctaaatatttgtcaatttttaaaaaaatctactttcagaaagagtttcaggtatctttaacagaagatcaacagattaaaacaaatttaaaagaattagggccaaatagtctagggaagaggagagatggatactattttaccagaaaacttaggctaagtagagctaccacagttcacttagcttttgctttctggcagtacaggccaacaagaaaacatggattccttaactaacattattaaata

SEQ ID NO: 262317 - DNA, 903 bp, Homo sapiens
gtaggcgtggctattttttgtatttttctagagacgaggtttcaccatgttgcccaggctgatcttgacctcataagctcaagtgatcctcccacctcagcctcccaacgtgctgggatcacacgagtgagccagcgcgcccaacctttaaccaatttcatatctacatagtccattttgtttctgtcaggctttctaattttcttttgcaacaagagttctgctttgttcttcctcttagattgcatatgcatttactctaataaatggtgcaaagaaagctttccagctctttttagtgatgtaacagaagagtgggcatcttggaaattagcactgttttgacttatatgagagggaactgctgtcttagtaactactacattaataagacaaatgtccagttactagttactactcagtctagttttgaaataacaagctaaatctaaaaatctcttagagtttgggtttcagcaaacatttatgaagctcctgtaatattcaaacctccatattctgtgatttctgctatatgctggtcaatctgaaagatacgaagatatgtaagagggctttaaccctcaggtgcttccaatcagtttgtaattattttccaacaataaataaattgaatttatttcattagatattttgagaactaagatattaataatttttttcttttttttccccctgaaattcctgagcttcaactagttggtctgtttttatagtagttatgttagctataaatgaataaataaaaatcagcctgccagtttatgtagattctcccctcgaggaggtggagcttaactcctccaccacttaggggtggatgatgagcttaatgacttgtttccacagagtacagtgtggaagggtggggagaagtactgc

SEQ ID NO: 262318 - DNA, 1747 bp, Homo sapiens
  misc_feature (2)..(3): n is a, c, g, or t
  misc_feature (1741)..(1741): n is a, c, g, or t
anngccaccatgctggcctcagggctgcttctggtgaccttgctggcctgcctgactgtgatggtcttgatgtcagtctggcggcagaggaagagcagggggaagctgcctccgggacccaccccattgcccttcattggaaactacctgcagctgaacacagagcagatgtacaactccctcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggcgtggcgttcagcaacggggagcgcgccaagcagctccggcgcttctccatcgccaccctaaggggttttggcgtgggcaagcgcggcatcgaggaacgcatccaggaggaggcgggcttcctcatcgacgccctccggggcacgcacggcgccaatatcgatcccaccttcttcctgagccgcacagtctccaatgtcatcagctccattgtctttggggaccgctttgactatgaggacaaagagttcctgtcactgttgcgcatgatgctgggaagcttccagttcacggcaacctccacggggcagctctatgagatgttctcttcggtgatgaaacacctgccaggaccacagcaacaggcctttaaggagctgcaagggctggaggacttcatcgccaagaaggtggagcacaaccagcgcacgctggatcccaattccccacgggacttcatcgactcctttctcatccgcatgcaggaggaggagaagaaccccaacacagagttctacttgaagaacctggtgatgaccaccctgaacctcttctttgcgggcactgagaccgtgagcaccaccctgcgctacggtttcctgctgctcatgaagcacccagaggtggaggccaaggtccatgaggagattgacagagtgatcggcaagaaccggcagcccaagtttgaggaccgggccaagatgccctacacagaggcagtgatccacgagatccaaagatttggagacatgctccccatgggtttggcccacagggtcaacaaggacaccaagtttcgggatttcttcctccctaagggcactgaagtgttccctatgctgggctccgtgctgagagaccccaggttcttctccaacccccgggacttcaatccccagcacttcctggataagaaggggcagtttaagaagagtgatgcttttgtgcccttttccatcggaaagcggtactgttttggagaaggcctggccagaatggagctctttctcttcttcaccaccatcatgcagaactttcgcttcaagtcccctcagtcgcctaaggatatcgacgtgtcccccaaacacgtgggctttgccacgatcccacgaaactacaccatgagcttcctgccccgctgagcgagggctgtgctggtgcagggctggtgggcggggccagggaaacggccggggcaggggcggggcttgtgggaggggcggggctaagaatgggggcagtgggggaaggaaggggagaggtggttagagggaacagaagaaacagaaggggctcagttcaccttgatgatgtccttcagagctgtgatgagaggaagggaaaccttacagtatgctacaaagagtagtaataatagcagctcttatntcctga

SEQ ID NO: 262319 - DNA, 282 bp, Homo sapiens
cgactgtatactgtatagacacatagagttaattcccacaagttgcctcaaactggagactataaagagacatgtctcacaagttgcctcaaacagaagacacgttaggggaggctcattcctgtaaatagacaagaaatttcttcttgtccaactggctactgcaagcattaaatgagatcctactggtggagtgttgtgtaatttgcaaactgctataacatagccactcatctcttgggcatcttggagtgtttcaggaagagctctggactcaatagc

SEQ ID NO: 262320 - DNA, 797 bp, Homo sapiens
agggctgcgttgcaaatgccattgtggaggcatcacccgatgtggtggacctgaacattggggaaatgcagtgctgcctgctgctgcgctggctggcatctgccctcctccgtctcctgggtgctgccacagagaagagagagagagtgaagcgggcagagactggctgttgccatcacacaactgagggcggacctggagctcagccggctgagggtttgagagaccgttgggagcaagacccaaccacaaggcccatggaagaggaagttggcagatctcagaaaggggaggaaaaggagaggtgcttatttgttcatcttgtttttgctttaaggaaaggaggagagttaaatgagaaaggagggcgagttgagaaggttctgagcagtttcaggtccacggttgagcaatgttcttcctggtcaacaaactgcctggatttcattttggcctgacaacagccccaccacctagggaactgcacagagatcctgtgtgttaaccacgcaagagagtctgcagttagaatactggggcttgtgcagagagaagaattcagaaagtcaaaggctggatgtaggtgaagagactatggactctgccttcatgtcatcagttaaagtgccctgcacacctgcctgtcctaggtcctgtagggatgtgatataacaagcatgagctgtaccttagtgtctgtgttccagaactttgttggctcccgaagcacctttccctcctcccaagaggaataagcaaatgtaaataaatggtgcccaggttttcatttggctcac

SEQ ID NO: 262321 - DNA, 433 bp, Homo sapiens
agtggatactaaagccagatgcaaactagcagtatctgtggcaagtggccaaggcctgggccagcctcagcccccctttctccagtgcccaagccccctgctgctgagatgagccaagagttgagctgcagccacctccacccctcctttgggcatctgacctgagttagtttggcaagtgctgcaactatagacccaactttgaaggcctgtcggggtcctgcagcagaggagacatttccctttgcaaaatcagggctaaatctctctctctctctctctttttttttttgtaatagactttatttttagaacagctttatttattcatttatagataggggcttgctctgtcacccagactggagtgcagtgagctgtgatcgcaccactgcaactccacttgggcaacagagcaagactcttgtctcga

SEQ ID NO: 262322 - DNA, 470 bp, Homo sapiens
cagtaaatctgagtctctcttcaaagggtttagcctgctaacttccttatccttgttctcaaattcaactttcttgttcttccttacccctagttactgtaaacagcctaccccattctcgtcagctttaatcaataattcacatctgttcccttggttacctgtacccattgttcccccgaaactgcacgcctcacactccacctctgtaactcatgtccccctccccttctatagttaggaaaatatgtacaagtggccaattgggtcagctcagattgtgcagtctgaccccagcccatggggggagtgacacagagatagggactgtgttaaggataaaaatcccctggtctcctttgttctctgtgctcttgtgatcttgattgacacaagtggcaccgttccgcagaagtaaattaccttgctgagagaaattaaacttttgcctgagtgctggttttacttca

SEQ ID NO: 262323 - DNA, 389 bp, Homo sapiens
aatttcagccaaattttgtcttgtgaatgatttaattttttttatgtacaaagtaattactgaaagggaatgacattgctttttgttttttattttagattttgtagcttttttgtttctgttttcctcttgctgtcttccttggtgttttattgatttttttttatagtggcatattttgattcctttctcatttctttttgtgtatctactataggtatttttgtggttaccatagatattacacaaaacatcttaaaattattaacaatttgtattaacctgataactttagtagcatacaaaaatcctgcctctctatgtccccttattgtattttattgaggtcacaaattatatgctttttattgtgaatccattaacacaga

SEQ ID NO: 262324 - DNA, 585 bp, Homo sapiens
gggctatattattaatgagatgtgttaaaagtactaaaagttcacatttgaagtgagctggcaagtccagaataagtccttttaatttttataccagtgtttattcctgttccccgggagaggaggcatttttttctgtcaacactgggcgatttaagaactgacttgggggatgaaaataactatggtgagtccacaggggcaaacagttctgctccagccaatccacatctgttcaccttaagtagagaggctggggtgagtcaatatttactcagcctcagtgcctcagaaaaggtgatgaattttatcttatgagctgctttcagtcatcatgtatatagttcacacaccattaataagaagactcattcaccatggaaataatctgctagtctgagagaatgttggtccctaagacaagcatcttgaagtatcaaagtttcatcacagatgtttactacttcctgtttctgtggtctaaaattcacctcaaatgtgtagttaacctgtaagtgatgaaccacttccatcacttccgcaataaaattaaaacgtgtctgctggggcaccccctccccattt

SEQ ID NO: 262325 - DNA, 388 bp, Homo sapiens
gaggagcagagccctgcaattgttggcagtttccctctgcttaccattaagggttcttctaatccattaacagtcccttttgaactttggctcacagacccatcccaagccagagcagtcagtatctccagatctccatactctactatgctttgagcaatagggttgacttgtgaactcatccacttttatttgagagaaatcaaagttgtacacagatgtgagtaagagaagaagaaagaaaccttctctcgctgtgtgcttcctgaaccttcataaactccgggggaagagcgtgagattccgggtccacttgaagatactcagggggacttagccagtgaaccagatgttagggtgatatttattaaaggcaggtccttcacat

SEQ ID NO: 262326 - DNA, 468 bp, Homo sapiens
catgcctctaagcaggtgagctccagccaagattatattgggcaggtaataaaattaagggcaataaaaccagataaaccacctcattagcagcagtgtactggtaaggccatttcaacaagaagaggaggatagatggaagactcaaatcctttgtcaagttctttccaatgtcctcctctgaaaaggaacattcttttcaggagtgttggcttggaagagagggcatatgtacatttatccaacacctgctgagaccaagtggtgattcagaggagagcctctggaatttggacctgtcacttgattgctactgagagatcaccagctgaactgcttgacttttctcagaacttttttatcagtcatgtaaatgagtgaagatcctgtaccagtctatgtaggatcaactggtcattgagtgtagctttacacattaaaagccacacttatattcatagtttcaaa

SEQ ID NO: 262327 - DNA, 242 bp, Homo sapiens
gtgaagcttcattatcacctaaactaagggactttgaacaccaaaagctttaagccctcaatgcaagaaagctaaatgcagaaactttggaaacctgattgggtttcactgcatttgattccaaagcaacatttctaaacagcactcctactctaaagacaaaaaaaagcggtggggactctggagtgttttttgtttttcatcttctctgtcagatgataccattccttctttgattatac

SEQ ID NO: 262328 - DNA, 404 bp, Homo sapiens
agagagtggttagtaattgagtgaaattggtgagtttggtggtgattcctgggtgcctggaactgactcccgctgaagtgtgggcgtggttggagagtagctgggacacacaggagagtccctgagggttggagagaaagacgtgctagagactgaggagtaactgagtgaaattggtggttggtggggaacgaaggaggcaggagtgggcagatgctggtgtgatgggcaggatggcaggggagggagagtgctggggagagtgactgaagggagatccaagcgcagagcccagagactctggcttagtagttacgggtgggaacagaaattcacctttaatttgtgccccaggaggctctgatgccaccagccaatcctggcatttgggatccatggggcca

SEQ ID NO: 262329 - DNA, 418 bp, Homo sapiens
aaaacttgtttgtggaggtctggggagtttcttcagacccctgataaaacttgtttaatcctaaacaggtcctgttaagaattccttcattatcttgtcatgcttcaaggcccaggaaaagcctagacaaactcttggtgggcttttgttacatataagcttttgtaaaagggcactggccctttcagcctttaacatttaacttacccactcagtcagggctgaaagttgtcttagaggcctgcctgttcagctgttagggagacctggcctgccacaggacctccatcatgggctaggcttttgccaggcccccaaacgaagccaccagcagagggcccagcactcagcgaatccaggccagacctgctgagcaacctctgctgccttcctggagtctgtttctgactgcaggatt

SEQ ID NO: 262330 - DNA, 402 bp, Homo sapiens
  misc_feature (3)..(3): n is a, c, g, or t
  misc_feature (5)..(6): n is a, c, g, or t
  misc_feature (8)..(9): n is a, c, g, or t
  misc_feature (11)..(12): n is a, c, g, or t
  misc_feature (324)..(324): n is a, c, g, or t
gcngnngnntnnagtaacggcttaactcttccagtcattcagactcctgacatgcaacgaggtctagattatttcaaaccatggttaagttctgatactaaacagccctttattctggtaggaccagaaggatgtggcaaagggtaagaaaaatattggcaaaggtatatgttgtggatttattcctgccgcccctaattgatttaatggcttttgttatgtttcttttggttaaagtagcatttacattttcatggaagattcattttattttcattacttataaaaataagaactatggggaatagtgtgtccttttctttnccaggttgtgtgatttctactggaaagacagcaatctgagaagatactcttaaaaattatccgtccatataatacagc

SEQ ID NO: 262331 - DNA, 689 bp, Homo sapiens
gtaatttcagtggctttgatcctttttgcatagttcccctctgtgcagaatgctgttgttaaatcatcagacttgatgctgtaaatcaacctgacatcttttttcatcaattaaacagtttaaaatctccaactgtgggccaaaaaagacaagacaattgagataaatagatgaatatgactcggtctcttcccttacaatatggtaaacatgtaaacaaagtgtctacaaaatccattacagatgctgctatagcagtatgtgccggcacagggccatccatgaggttgtttttgcaatgaagtggaggaggtgaggaagcacacttccagcattgcttgttaaagccttagggctagggttccatgattgagagtttattttagtacactagcatagtatttaggagagtgctaactgctataacaaagagacccccacataggcaaatacccaagcgagataagttattttctcctgatgtcacagttaagagcaggttaaggcagaagttcccctccacgaattaattcacccaggctgatagctgttctgccatcttcaatgtgtgacttagaggactgctgttgtcatcactatccaccagcaggaagcaaaaacaacagcagcaaaaacacaagttcataacaacatatgttctcttatgaaagtcaagatcacagctctat

SEQ ID NO: 262332 - DNA, 490 bp, Homo sapiens
caggggacttaaaattggttacatatttgcttcggtttgggcaaagaacatcttcttgtggtaaacagctactaatattgttataaagtaaacggtttaaattcccctatgaagctactatttacagacatgtggaaagtaaaggaaataaatagtaagtccccctccccagcctacagtttgagaggtggaactgtgatgaatctaataagcctttgcttggcagcctttctggaatttttcaagatcaattatgcagcacttgccaagccctcctcctctcctgcccccagtaaaagaacaaaaagaaagggggtcaatgtgtaataaattgtcaataaaaggaccatctgcaagtcccgtttaaatattggatttgcctttgaaggcatctatgaatattgaccagggtaaatgtgttaaaagggtgaaatttttaacttataaattttcccagccattttacctcgttaaataaagagaaaaagaa

SEQ ID NO: 262333 - DNA, 358 bp, Homo sapiens
tgtgtcaccttttcagtgactttcttattctagagcaggggttggcaaacgacagtccacaagcgtctgtttttgtaaataaagttttattggagcatagccacactcatttatttacatatcatctgtggctacttttgcattataatggcagaattgactgcaaagcctaaaatattcactatatggcccttaaaaagcttcttttccttttaaaaatgggtttagatgggctgggcacggtggcttacgcctgtaatcccagcactttgggaggccaaggcgggtggatcacaaggtcaggagatccagaccatcctgggtaacatggtgaaaccctgtctctactaaaaataca

SEQ ID NO: 262334 - DNA, 454 bp, Homo sapiens
atcacttgagcccaggagttcaagaccagtctggggaacatagcgagatcctgtctcaaaaaataaaaatatcaaaaaagcttgtggattctgaagcattatacttgatgtgggattttcaccccgtctcctgttgcccgttttcccccacctgcaattcatcttccacattacctccagagcaactgttctaagcacagattttatttcatcactctcttccttaaaatcctttgatggtccccattttcttcaggatgaattcacattccttagtaccacccagcaggcaagtcctaaactggcccctgcctgcctcttcggcttcattcccctgtcactccaaagatgctgcagccctttagaactacttttgttcttagaagttaataatgtctcatatccatacctttacaccaatggcatcttttccttaagaaacaaaacaaacaaa

SEQ ID NO: 262335 - DNA, 601 bp, Homo sapiens
atatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacaacctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaaataaaaaaataaataaaggctttaactatttatttagtccaaggacttggcattaatccatagtgatttcttggtgatattttaatctgtaggaaacagatcagtagatcagtaaattggctaggc

SEQ ID NO: 262336 - DNA, 402 bp, Homo sapiens
tttaccggaaatgtattagcagagaccgactgaacagtcatctgggataattgcagaaggtgaaagttgggctttaagtatctttatttcacccattaatatttaatacatatagtatagctgacatgcttacatggacatctaggtgtgttgtagctgtcctgatttgagtttaagcttcattttgtgttgctctcaccaagatttaccagccatattttacagatttgtagtgatatcaagtgctgagaactaggataagaggaaaattcgaagagaaaaactacaagtatatccgcctttattctccgaaccatttctcattatttagagtatgatgaatgaatcaaacaatgatcttgggtatagttcttcagatatctgttctcaaacagtgtggga

SEQ ID NO: 262337 - DNA, 661 bp, Homo sapiens
aacggcacatattttacagtcatttgctagaatacctccacttcaatgatgtcatccagtgaccccgacaaaaggattatctcaatgtcttgcactttgcaatcaagcagcaagttatgcttctctaatcgtttctgttccagagaagtttgaatacttacaacttctttttgcaatttccccacttccctgtaattacacagatatgaaaaagtaatttactcattatgtaacactgcaccaaggaagaaaaatgtatgctatcttttatgaagaattatttattcctgtgagtgctgtaagttctagaatcctctcattgatgctgtaatttaattgttaacactcctgagaaaggtcacgaatatactcagttaatctaagggagcattttccactaataaatgttactgatttaatcagggttaccaaaaacagtgctttcctcactcaaatataagctctacattttagacctcaaaccaagataaacagactcttagcaaaagaaatcccttgccagtaagtcacatacacttaataatctgttttccttgctaccaccaccactaatgtagtaacgccttctatctgaaaatgagggcttgggttttactaatcgaaatgatgtgagatttttaaaggaacctggaaaaaggac

SEQ ID NO: 262338 - DNA, 441 bp, Homo sapiens
gaggttataccaatttgcactcacagtagcagtgtaggagagtttccattgccccacatcttcaccatccttggtattgacaggtattgttttgttttagccattttggtgtgtgtattaataagggttctccagagaaacagaaccaataggaggggtgtgtgtggggagaaagattatttctataataaatctcctcttacatacatatatacttattatggaaattgactcatgattatggaggctgataagtcatataatcaagttggggaaccaggaaacctggtgctgtaacttagtctaagtccaaagacctgaggaaaggggagagaaaatggtttaagtcctgggctgagtctgaagaccaaagaaccaggagcactgacgtccaatagcaggagaaggtagatattccagtcttaaaagaaaagaaaaaac

SEQ ID NO: 262339 - DNA, 94 bp, Homo sapiens
aatgctccttttcctctgctctctcttctagaattacattatttcaggaatgtaatatgaataggaattaaaattttatttatggtaaacaaat

SEQ ID NO: 262340 - DNA, 935 bp, Homo sapiens
caggagtcctcaggcagcagcatccgccgaggcccacccgggccacccccggggttccaggcctggcatggttcagggcccatggggaactgtgccaagcggccctggcgccggggccctaaggaccccttgcagtggctcggctccccaccaaggggctcctgccccagccccagctccagccccaaggagcagggggaccccgcgccaggcgtccagggctactcggtgctcaacagcctggtggggcctgcctgcatcttcctgcggcccagcattgccgccacccaactcgaccgggagctgcggcccgaggagattgaagagctgcaggtcgccttccaggagtttgaccgagaccaggacggctacattggctgccgggagctgggtgcctgcatgcggaccctgggctacatgcccaccgagatggagctcatcgagatctcacagcaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctccttttctccccatcccacctgtgtgcagtgcccttgcctgccttacccccaccaccactttttcaataaagccgcctggccttgtctctgtc

SEQ ID NO: 262341 - DNA, 764 bp, Homo sapiens
caggagtcctcaggcagcagcatccgccgaggcccacccgggccacccccggggttccaggcctggcatggttcagggcccatggggaactgtgccaagcggccctggcgccggggccctaaggaccgggagctgcggcccgaggagattgaagagctgcaggtcgccttccaggagtttgaccgagaccaggacggctacattggctgccgggagctgggtgcctgcatgcggaccctgggctacatgcccaccgagatggagctcatcgagatctcacagcaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctccttttctccccatcccacctgtgtgcagtgcccttgcctgccttacccccaccaccactttttcaataaagccgcctggccttgtctctgtc

SEQ ID NO: 262342 - DNA, 311 bp, Homo sapiens
ctctgcttgattatgttgctataaattactgtctgtcctgaacagagtccatctaactgagtgtcctgctgcctgtaggaagagagagagagagacagagacagggagaaacagagagagagagagacagagacagggagagacagagagagagagacagagacagggagaaacacagagagagagaaaatagttttctggaaaagagaaaagaaacataatttggattcatgtctagacagagatagggagaaaaagagagagaaagagagagggggcaggtgaggggcggaatagttgtccagaaaaga

SEQ ID NO: 262343 - DNA, 752 bp, Homo sapiens
ccttttccatttatatcagtctctatccccaaaggtaaccactattaacagtttcttacaacttttttcttgccagggtgcgatggctcgggcctgtaatcccagtacattgggaagctgaggcgagaggatcgcttgagcccaggagtttgagaccagcctgggcaacaaagtgagaccctgtttcttcagaaaaattaataatgagccgagtgtgatggtgcgtgcctggagctccacctgctgggaggggctgaggcaggaggatcccttgagcccaggagtttgaggttacagtgagctgatctcgccactgcacttcaacctggaagaccatctcaaaaaaaaaagctttttttctttattgacctaaaaaggattatataaagcaatcacactgttttgctgcttacattttttccacttgataacatcgtagagatttttcatattactacatgtagtcaatctaattcttttaaagagtggaataatattccattttatggatgtaaatcacattttgaaagtaaggcacattaaatttttagataatgtattaaacttggatgttctgcttcctgtagttaaattgctgcctgtaagaaaatgaattaaatggtgtgtgataaaacacatactttaagatcagagggtactgtggggcccagtggtttgaacgagcctggcagagtaacctgggaatgctgttgaaatacaaactctcatatttactccaaatctattaagtc

SEQ ID NO: 262344 - DNA, 400 bp, Homo sapiens
gctgctgctgaactttacagactgaactttcacagagctcttagaggttctctacaaatggaatccttttaggcacttgtgttataaaatgttgattgtaacatttgaaataagtgtgagttaatggaaagggccttgtctttgcctttaggaagtttctactttgttatcctaaacctgccccttcacacctctgtacttcaggaacccttgaaaagttctctctcccattgaagtgaaacatgggtctcatcagagtattcaaatttgtctctgtatttgttacagtgtctgtgtggaggaggagaacgttggctattatgtcctaattttacatttgattaaacctgtgactttttttttcttactgctaatttttaagtctccccacatcaaagtt

SEQ ID NO: 262345 - DNA, 253 bp, Homo sapiens
gttctgtgcagattgtgtctgccaggcgagcattaagattactgtttctgagatcttttggttgctatcagactggactcaattttttttctacattctcaaggttaagttgaaacagtattacccattatttataaatggtaagtgtttaggttttgccttgtgttacaaactagaatgttaataaaaatactatatttaacaagttgcaagtttatgaaagtcattgtttttgaaagtaagttttagatta

SEQ ID NO: 262346 - DNA, 214 bp, Homo sapiens
gtcttgtaggactgagcccttacctaagggatctctacttgcttctagtagtgagtgtcagaattgagttgaattgttggacacccaattggtgtcagagaattgcagaaatggtgttggaaaagacatcatgtatttgatgtcacagagaatctaatgaactatctagacaaaaattatttttaagatgtgctgttgggattatacctcttat

SEQ ID NO: 262347 - DNA, 520 bp, Homo sapiens
gcacgaggtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggagaccggagaagagcagaaccaacttacaggaagaattgaaaatcctggtactggatggctgtgataagctgttctccacactctggcctggcatctgagaactagcaagcctctcttaggccatatgggcttctccaccaaagctgtttggcagctcctagcagaccttcttattgaaatcctcatgctgaaaatgaacacagcctagttgccaacccacatgtccttttcacctccagcaagactaagcttctttaaagcacttcacaggactaggaccctgtcctggag

SEQ ID NO: 262348 - DNA, 356 bp, Homo sapiens
gcacgaggtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaa

SEQ ID NO: 262349 - DNA, 524 bp, Homo sapiens
aatttactcatccattctagtgtgggtggcatttgggtggttcccatctgaggctgttgcaaatggaattgctgtgaacttcctggtgtatgcatttcagagcacataggttcccattctggttggcggtccccctggcaatggaattgccttgccatgagacatgcacatgttcatctctcgttgatcatctgagaaactctgcaacctggttgtaccaatttgcatttccaccagctggtgagtgatagttcaggttgcaccctgttgttgccagtccttcaaattgtctgccattttcatatgaactcttgtgtatggtttttaatgtgcatttctctggtgactggtgaagataagccctttgttatatgtttattgcctcttttgtaaagtgtccgtgcaagttttttgccaactatgggattgtctgcctttcattctgaatcataggagttctttatctattgtggctatgagcccattattggatatgttcatatattatgaatgtcttatcccac

SEQ ID NO: 262350 - DNA, 816 bp, Homo sapiens
ggccacccgcctttcactatccgccattcttgtcacctcagctgctgccctcgctaccgcaccgacttcgcccgtgtgctcgcctgcacttgcgctgcccgccatggccaccgcccagccgtcgcaggtgcgccagaagtacgacaccaactgcgacgccgccatcaacagccacatcacgctggagctctacacctcctacctgtacctgtctatggccttctacttcaaccgggacgacgtggccctggagaacttcttccgctacttcctgcgcctgtcggacgacaaaatggagcatgcccagaagctgatgaggctgcagaacctgcgcggtggccacatctgccttcacgatatcaggaagccagagtgccaaggctgggagagcgggctcgtggccatggagtccgccttccacctggagaagaacgtcaaccagagcctgctggatctgtaccagctggccgtggagaagggcgacccccagctgtgccacttcctggagagccactacctgcacgagcaagtcaagaccatcaaagagctgggtggctacgtgagcaacctgcgcaagatttgttccccggaagccggcctggctgagtacctgttcgacaagctcaccctgggcggccgcgtcaaagagacttgagcccagatgggccccacagccacggggtcccttccctgggtcaggccactaggcggggcgtgcatgttgccctttcagaacgttctcttcagttttatctttcagttttaccattgttagcaaaaaagttatctggttctcaaagcaataaaggtgtccat

SEQ ID NO: 262351 - DNA, 424 bp, Homo sapiens
aatttttacccataatggatcatacccacagtcacaaccgatgcaagatttacatggtgagattttggatgtttcagctgatgaggtttatttgagattttggacttaagtagatactgtaatgtgttgagattttggagatttgatatggggtttatatactttgcatgtgagatagctagtcctttaggggaaccaagaaagaaatattgtagacagaacaatggttccccaacatacctatatcataatccagaaagccagtagatatattacctagatgaaaaaaggtatttttcaaacataattgcattaaggatctttagatcttttaacacaagtcaaattatcctgtgttatctgagtggatcaaatgtaattacaagcctcctaatgagagaatacaagatcagaaggtaaaact

SEQ ID NO: 262352 - DNA, 1330 bp, Homo sapiens
  misc_feature (76)..(76): n is a, c, g, or t
ctctaggatcttgtcagagctgcacctctctgtgaactggccattcctttcggtgctgctgtcctttttggggggnttcctgatttctgtatacatgtagctttgccagatatgtacttaataatatagtatattaccatctgcgcattttccctcaattctttcctgatggtagctgatgaaattgaaatggtaatttttagaatgttctaatatttgatgtatttaaaatacatcaccttttattggcctgctttatatgggaacaagaaagcctacctagcaaagaaatacaacctagttttatatcttatttattctgtaagtccttgtgcagcagcatgttaatgtggacacacagcttgtagataatttaaaatctagaaagggagaatgagatacatagagaaatagccaccacataaggcagtttatgacgaatacagtgtgttacaaatgacaaaagccacaggaattcagaagagggaaaaataaggactggcttcctaaagaaagtggcaatttttttagaatattgaagctgttactctgaggcatgagtgacacaagccagcagaagccagagatttgaagtcttgctcaagatttgctggtttccacttggggaaagacaccattaggctgggtacatctggagagatgagtgcaagaagccagttaagcaggagagaagtggacttgattgtggaggcactgtgtttcaaactcaaattaggcagctcttgggtgggtggctgataccattgttgtgttttcagctgattaatctggtagcagtgtgctcgtttaggagaaattacacaggagatcagtcaaagagaatggtcctctggtttgggaatgaaataatcagggcctgtacctggagtggggcaatgatgattaattggaaggaaatgagaaattgagaagacttgacaggacttggttactcattgtccggagtaaaggaaaagtagaaataggtaagttaattatcagtttggggaaggtgattatatagtttagtcttgttgaatttggcctggaataggaaggtatatctcagggcactgcaataacttgtggctgcaacttctgagccccatgtaacctttgaggagtcatggaatctaggagaggtgccacaatactagaagtgagaaatattctgtgtttttttaaagataggaaaaagatagattctacaaaatacaatccagcaaaattgatactgattttaggttattaaaataataagttgtgagcatatagaaaaataactggttaagaagtatgaaaaaatgcccaaatctcactacaataagag

SEQ ID NO: 262353 - DNA, 457 bp, Homo sapiens
tagtcacatctgtctaattggcaatgggtgaaggctgcgtattttattctctgtcttcggaggtgctgtgtttccgtttccatcgctgatatgcttggatgtcctgtcacctccaaatcgcatgttgaaatgtgacctccactgttgggggtgcctagtgggaggtgtttgaatcacgggagtggatatctcgtgaatggcttggtgttgtcctcatgataatgggtgagttatttttctattcgttcactagaacctgattgtgtaaaaagagcctggcaactcctacctctctctttttgctctgtctctcgccacgtgacatgcctgtacccacttcaccttctgccatgattggaagcttcctgaggcctcaccagaagctgagcagatgctggtgccatgcttgtacaccctgcagaactgtgaaccaaataaacctccttttgttacgaat

SEQ ID NO: 262354 - DNA, 358 bp, Homo sapiens
gcagctgaaccggattagcctctgcccggcgaggccagggattcctcattcatttattcaggcaaccattcagtgtttaccgagccaactctgtgttccggatacagccctgaccattcggtccgaggaggtgtcagtaaacaaacaaggtcgttcctttgggttagctttagaattccttgggcttggaggcggaaagaagagatcttagcgatctccacagtttcctcatctgtgaaatagagataatagaaattcctacctcatagggttgtggtgacgctcagtagaaaccgggtgacgctcctgcttgcagcgtttgacttgtggcttagcgtcattacccgcttacgttgat

SEQ ID NO: 262355 - DNA, 409 bp, Homo sapiens
atcctcatgccctaatcacctcccaaaggcctcaactcatttgggattaggtttccacataggagttttgcggggacataaatattcagatcatagcatttagaaagcaaaaaaacaggctgggcacggtggctcacacttgtaattccagcactttgggaggctgaagcgggcggatgacgaggtcgtgagatcaagaccatcctggctaacacggtgaaaccccgtctctactaaaaatacaaaaaattagctgggcgtggtggcgggcgcctgtagtcccagctgctcaggaggctgaggccggagaatggtgcgaacccgggaggcagagcttgcagtgagccgagatcgcgccactgcactccagcctgggtgacagagcgaggctccgtctcaaaaaaaaaaa

SEQ ID NO: 262356 - DNA, 479 bp, Homo sapiens
ctttctctacctctctgcctctcatttccatgcagaagggaataggagaaaataatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgagatttttctaatgcaaaaaaatttaatgtattaaatatcctgtcagttgaaatgagaactctactctgcaatgcctcagaataaatgagtttccctttacaagaagggagggttaaattcattgaaa

SEQ ID NO: 262357 - DNA, 357 bp, Homo sapiens
tttgttattctaagagtttagaaatataaataactttaaaaaatactttgtaaattatagaaggtattttattttatcttatttatttatttatttatttgagatggagtttcgctcttattgtccaggttggagtgcaatgatgcaaccttggctcattgcaacctctgcctcccgggtccaaactattcttctctactcccgagtgcctgtaatcctagcaactccggaggctgggcaggagaatcacttgaacccaggaggcggaggttgcggtgaaccgagatcgcaccattgcattccagcctgggcaacaagagcaaaactccgtctcaaacagacaaacaaacaaaaaaa

SEQ ID NO: 262358 - DNA, 342 bp, Homo sapiens
  misc_feature (1)..(1): n is a, c, g, or t
  misc_feature (89)..(89): n is a, c, g, or t
natcctgtaatcccagcacttcgggaggctgaggtgggtggatcatgaggtcaggagatcgagaccatcctggctaacatggtgaaacnctgtctctactaaaaatacaaaaaaaaaaattagccaggtgtggtggccggcgcctgtagtcccagctactcggaaggctgagacaggagaatggcgtgaaccgggaaggcagagcttgcagtgagctgagatcatgccactgcactccagcctgggggacagagcgagactccgtcaaaaaaaaaaaagggcaggcgcaaatccatatttatagtaaagtaactttcgcagattgtgcctctatagtctcct

SEQ ID NO: 262359 - DNA, 465 bp, Homo sapiens
  misc_feature (7)..(7): n is a, c, g, or t
  misc_feature (10)..(10): n is a, c, g, or t
  misc_feature (12)..(12): n is a, c, g, or t
  misc_feature (34)..(35): n is a, c, g, or t
cctcgtnggncntactcggtcccggcgctgggcnnaggggaggggttgtcttaaaagtctcgccttccccctgtagggccggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgaggtggcaaagcagtatatagagaaaagtcttttggttccagaccatgtgatcacacgcctaatgatgtccgagttggagaataggcgtggccagcactggctcc

SEQ ID NO: 262360 - DNA, 552 bp, Homo sapiens
ttgggagattccaaagattttatgccaggagatggtaggaagaccaaataaatatttcacaatatcacatccctaatgtaggtcctattatcaccattctcattttgcaggtgaggagactgaagcatgagattaagaaatcaagaccgccttccccctgtagggccggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgaggtggcaaagcagtatatagagaaaagtcttttggttccagaccatgtgatcacacgcctaatgatgtccgagttggagaataggcgtggccagcactggctcc

SEQ ID NO: 262361 - DNA, 145 bp, Homo sapiens
ccttcctcgtgctacctagtctaagatcgtttcacttttcttccacttgttggtctgtcccttgcacttcacttcattttcttctaagtggcccaatctactgagtcccccacaaaaaggcagatatagccatctttgctcttta

SEQ ID NO: 262362 - DNA, 560 bp, Homo sapiens
agttggagagtgtgagcataggtcaatgagagcaaaaactgaacagctagtatttttcagaattgcaaaaacttcttttggggagggagtgaatgactgcagtagaaaagtttgagtcccttttatgaaaggtttgcccaattacaagaaaatatcgcatcaagaattgttagaccatatatgaaactgaagttaactatatcaacctaatacaatgaaactctgaggttaaagtattcagtggccatccagataatcgtaagagaaagtgaaaaataataaataatctattttcagaactttgtaacctaatagaagacataattcgaaacatgtaagctacaaagaatgtacttggattatactgcagagtgggtggccgcatgagtgacagaaggaatggtgaaggaaaggtgggcagtaggttgttttcaaggcagtaaatattccttttacatttcttatacacttgatgggtcacatggttaactactgctgtatagattttgttgttgttttgaaatattttgaaaataaagcatctttttaaaaatcaactt

SEQ ID NO: 262363 - DNA, 710 bp, Homo sapiens
gagagagagaactagttctctctgctccagctgggcaagtaaccttgttattgcatacacaggtaagtcaattatacattttgcaaagagtactttgtcacaggcctcactataaatagcaatgaagtagcttgatttaattgaaataatgtgtaacttcttttatataattggatttagtttctagtccttgtatctgactaacagtaaagcatattaacataaaaatttattatttaataatttctacatatgtttgcttatgtgagagtagtactaagcaaaaaagcctcagggcctcaagttccagagagaatagagtaagaggcagatgatgctcaaacgtacctcctcacatttactcagatgttttggatactgtttggtgcttcttggatttttctttcttcttttttaatctcaaaatttgactatagcaggaaatttattctcttgttctgatcatcctttaatctcatattttcttcttcccatggtcaaaacccttatattgttattataatatgagtatttttgtattgctagaaatcttaagctgattttctggtctttaatatctcttccttccaaagactcattaccagcaagtaatttttattaaaatactgttttaattaaatgcattttaatccatattgaacagcaagtgaacctttaaaaatattattaaataaaattatctatctttt

SEQ ID NO: 262364 - DNA, 645 bp, Homo sapiens
gcatctcacctggcagccactccttctcaggctcgggcctcccctgtcgggtgtgcggggtgcacgggctcagcggctgctctctgctctctttgctatacacactcctggtcccctcgcctgctgacagctcctgctcctccctccatccttgacctctcccgagcctggactcacatctccttgggtgtccagtgggcacctcccgtgtgacacgtcagtagatgaatgaatccatgtgacctcccccagagctgctgatccgggcatccccagttcagccggcagccgctccgtctccccttgctccagtgggaaccctggcgcctcctgggcacccccattcctctagaccacatctgttcatcatcagctctgccttcgactctgccatgtgtgcactctgctccagctgcactggtctcctagtgtttctggaacattccacgcgctccccactgcactagctgttgcctccacctgggaaactttccccctgatgctgtcttggcctgcgcagccacatagcaccttggcagggaaaggggtgtgtgtttaccccttcctcaagcaaaaagtggtaaagttcatgtctttatttcttgataataaccattacaaaaaaaatgagtttgttacaacaaa

SEQ ID NO: 262365 - DNA, 416 bp, Homo sapiens
aaccttcatttaaccctaaacccaatgctttgatcccctgtacggcccgtgttccacgggatgcgccagaggctcaaatgttcctcattgacaagaaacgagtctgtggtttggccacttcccaattccctagctcagaacacacattcaggtgtgtttgccatacagggtcattctcagggtaagcttaagttattgctgtcaggtgttcttaccatacacctctggatctgccccacctctgttgctaaccacaaggactacaactagagttaagtcatgggccgggccacagtggctcatgcccataatcccagagctttgggaggcagaggcaggagaattgcttgaggccaggggtttgagaccagcctgcacaacataatgagaccttcatctctgcaaaaaaaataata

SEQ ID NO: 262366 - DNA, 471 bp, Homo sapiens
agcaaagagaccaccaccagtcccagtccttaatggatggggatctctttttctggccatcccaacctcaacatcttggcttttgactttggacagctgttgtggatgcagaacgagagtagacacccctgattactcaagggcccactctgggtcagtcagtgactgaatattgtagccttgcaataccatggccaagtgaacatggcccgcccccagtgggcccttcttttcctgcactgttgtctccccagatgtacgctagctaggcttatttttaaatgacagctccctcttgccagaactggaaaaaccaggaactgacagtacatggtgtgttcctacataacaatgataatcaatcttgttaatcacttggaaacaaaaaatgaattggaggctctttctagcctccagggaaatggaagcctttcagttcttagaatttcacaggcctcacagctatcttat

SEQ ID NO: 262367 - DNA, 343 bp, Homo sapiens
cttttccatataactatatatatataatttatattatatatatatataatgcagaatcttttcatgttggtgtatagagagcttcctcattttaatctgcatatcacaatattccattgtgtgcataaggtctatataactagtcctttcctgatgtatccaactttttttggatacatcatcagttacgaaaaaataagcacacactcccagtataggtttattgacaaattatgtacataaagtaccaccaatccctgtaagcaaactcagtgtcttacactgatagcttaaaaataataaaaatgcagcctgggcaacatggcgaagccctttctcgacc

SEQ ID NO: 262368 - DNA, 219 bp, Homo sapiens
gctttctggaagatgagagaccacatggaacagagaccaatgatctcggctgaagacaacttcaaccagttcccggctgacccaccaactgaccacagatgcaagagtgagcttaaccaagatcagctgaggttggcccagatcagcagaaccaccaacccagtcctaagttcacaaacaaaaataaattttcattgttacataccactgtgaaggaaa

SEQ ID NO: 262369 - DNA, 442 bp, Homo sapiens
gatctttgttaagacaaaaacaacaatcactaaggacaatcttttcagtaaatgctgctgggaaaatgggacagccatatacagaataatgaaaactagacccctatatctcaccatatttaaaaattacctcaacatggatcaagaactgaaatataagatctgaaataataaaaatactggaagaaatcctggaaagaaaactcttctggccaccaggcagctaattcatgactaaggcctcaaaagcataatcaacaatgacaaaaatagacatatgggacttaattgaactaaaaagcttctgcacagcaaaagaaataatcaacagggtgaacagaccagctggcaaaatgggagaaaatatttttaaactacagatctgattaatgattaaggacttatattcagaatttataaataactcaatccaacaacaacc

SEQ ID NO: 262370 - DNA, 323 bp, Homo sapiens
atgatatttttttgttttcaaatcaaatgaggtttgtatgtaatattaactatgaaaagaatgtaaaaaataaaaagaaaggttaggaaggccaatatacctagagttaagtgttccttgaccttaagtggtgtgatcatagttcatttttttctttactttttaaattttcagtttttcaattttctataataagtacttattgcttttaaattttatttaattaaattaatttatttatttgagacagggttttgctctgtttcccaggctggagtgcagggtgcaatcatagctcactgcagccttgaactcctcctggg

SEQ ID NO: 262371 - DNA, 394 bp, Homo sapiens
atgatgaggaacgccggtggtctctagaagctgagaatggcctttggctgacagcctgcaagggaatggaaacctcagttctactgtaacaaggacctggattctgccaataacctgaatgcacttgggagcggattgtttcctagatcctccagatagagctcagccagctgacacttggacttcagcgttataagactctaagcagagaacccagccaagaccacccgactctgacctacagaaatgtgagataattaatccacgttgccataagctgctaagtttgtgaaaatttgtcacacaacaatagataaagatgttatctcttatgtctaggcaaatggaactcctggctgagttatgaaataaataaaccccatctaaattttca

SEQ ID NO: 262372 - DNA, 446 bp, Homo sapiens
gatgccataccttctctatagctacctaatactgatttattgttttcctgggaactctggtttccttactgcatatggaacagaaacaagatggggaatgtggagaaaaggaaaagaagacagcagtccaaatacctcctgagttacgatacttataagagagattgcatcttgatttctggttgttacaaaccatgcactttctatctagtagaagactatgtggcaggtgaaccacttctttcatttttcagcacagttcattttttgtagcagtagaaaatcctaggctctggcagtttgtgatgtaagttttggtggtgtaaattttcatcatcttctattttcttcattcaaatgtaatggacactttgataggggcagcattaggatccatggagaggcaccattgtaaactggaagctgagtgatttttaaaattgccc

SEQ ID NO: 262373 - DNA, 597 bp, Homo sapiens
gagacggagagacggagtcttgctctgttgcccaggctggagtgcagtggcaccatctcggttcactgcaagctccgcctcctgggttcacgctattctcctgcctcagcctctgagtagctgaggcacgagaatcatttgaacctgggaggtgaggcttcagtgagcagagactgtaccactgcactccaccctgggtgccagagtgagaccctgtttcaaaacaaatgaacaaacagacaaacaaaaagaagacaaatgaaaaaattgtatatttctgtccctaatcctgcaggatggaattagctctcctaaaatgagctcaaatcttctggaatttgttcgagatgtcccgcaccgttctgtgcagatgcacgcacttgctgtggccactatgggtctccagtctactctgaaaataatcccactgtcttcaggctgtacctggggaaaggtgtcattctgtgaatgaagatacctggtgaagttgcgggtctttgggagctcctggcccacactgtccttataacgcctgaacccacatccgtggccacatactacgggaagaagcagaatctggccccagaactggacaca

SEQ ID NO: 262374 - DNA, 651 bp, Homo sapiens
agcagtggctcacacctgtaatcccagcactttgggaggccgaggtgggcggatcatctgaggtcaggagttcaagaccagcctgggcaacatggtgaaaccctgtctctaccaaaaatacacagtttagccaggcgtggtggcacccgcctataatcccagctactcgggaggctgaggcacgagaatcatttgaacctgggaggtgaggcttcagtgagcagagactgtaccactgcactccaccctgggtgccagagtgagaccctgtttcaaaacaaatgaacaaacagacaaacaaaaagaagacaaatgaaaaaattgtatatttctgtccctaatcctgcaggatggaattagctctcctaaaatgagctcaaatcttctggaatttgttcgagatgtcccgcaccgttctgtgcagatgcacgcacttgctgtggccactatgggtctccagtctactctgaaaataatcccactgtcttcaggctgtacctggggaaaggtgtcattctgtgaatgaagatacctggtgaagttgcgggtctttgggagctcctggcccacactgtccttataacgcctgaacccacatccgtggccacatactacgggaagaagcagaatctggccccagaactggacaca

SEQ ID NO: 262375 - DNA, 408 bp, Homo sapiens
tgaagtgtcagaaactcagcccagtgtaggcaaaacagtagagccaagtggctcaaagaaggggaagagacctatgaggaggccaaagcggtcatatcacacaaggtcttgaatgccacaccaaggaggttgaactgagtccaggagttgatggagaacctttcaacaatttaaagcagatgaatgaagatgtttataaaaatcttaacactcgtctctaagctcctgggaagcagggatgatggctcatttctctctgtcccccctgcagtgccggcctggctgaatggctgtttccccaactataaaatgctttcaacacaagcttgatgattttctatggtccttgccacaattgttttgttttttttttaaagtatttgagagcctgacatttttcttaaaaaa

SEQ ID NO: 262376 - DNA, 795 bp, Homo sapiens
tgagcccctgtacctggccttttttgttgttgttgtatttttagtagagatggggtttcgccatgtaggtcaggctggtctcgaactcctgatctcaaatgatcctcccgcctcagcctcccgaaatgccggcattacaggcatgagccgcctggcctggatagatgtttatgatacactgttgcatgaatgaagcaggttacaaaacagtgaaagtatggtgaggccttttcacctttgctttttattgatgtgaaattcatataacataaaactaaccattttaaagaatgaaatccagtggcgtttagttatttaccacgttgtccaaccatcacctctgtggagttctgaaacattgtcacccccaaaggggcttgtggctctgaagcaatcaccccccactccccctccctggcccccggtaacggggtcggcttcctgtactgcggctctaccagttccggtcgtttcccctgcggtgaatggaaccaacactctgcggccttcgtgtctggctctttccacttagcataacgttttcaaggttctttcacatgaatcagtgcctcagtccttttcatggctgcataatattccgttgtgtggacattccacactttgtgtgtccatccatcactgatggacatgtgctccgttcctgctacttgtttattgtaaactgtgctgccatggacatttgtatgcaagtatttgaacacctattttcaattcttttggacacatgcctagaagtggaactgctggttcccaataattctgttgaacgttttg

SEQ ID NO: 262377 - DNA, 339 bp, Homo sapiens
ctaatggtcagctttggaagttcagtgttaggtaacccagccaaatacttacgtatacaaaataaacacaagactgaaaaatagtaaatgtttaacctttgtgtctcttgctcactacagcagcctttaactagccaccaagccatagttcttttgtttgtcatagttgaatttcaaaatgtctttttaatgaagcccttcctgattggggagaaaggacataagtattgtgctttagttttatgtgctggtttataaaattgtgtatgttgactcaatatccccataagcatagggaaaggaaaacaggtcattttttgttcagaatcttatttgaga

SEQ ID NO: 262378 - DNA, 802 bp, Homo sapiens
cacgcgcgtgcacctgcgatcgcgacgcccagccttcgcgccttctccctccgcgctccgccccctctgagcccgggggcacggggcggggcttgccggcagccaatccccggcggccacggcgggaagagcctcgcgctgcccaggaccgtgtgccaccgaagagtaacggaactagcgcaggagctggcgaccgttgtccctgcgcccggacctcgggccgcaacctctgccctaccgccaaaaataacgtctgcagaaagagtggagtagagcggagtgggtgggcgaggggcttccttcccgggggtgagcggcgcacgtgacactcctgggcgcgtgtgaaggcagcgcccggccgagaccggctcggtgcagacgcgggctgtcggcggcagaagggggctctctgctcagtggggcgcggccgatccgcacgtgcggccgccgcccctttctccagagctcgcagcccgacccgcctctgccatggcgctcaccccgccgcccccagctctgggcaggaggtggcggggctgggaggcgccagccgcggaggggaggggcgcgcggagttgatgggccgctcgccgtccgtccaccgtctgtcgctgcgccggggatactcccgccgcctccgctcggtcctctctggtccctgggagcgtgggctgggccgcagggggcttccgtgggcctggcctctcccaccgcaggaggaaagagcagggggaagcccccggcgcccgccgcctccgagagccacggtgtcctcgggccgggcaggcgttgaagacgagcc

SEQ ID NO: 262379 - DNA, 406 bp, Homo sapiens
gacctcgtcactgaagaaggacaggagaaacgggtacaacaaaagcagtgggctggggtccccatctgggggaacactaggccctaaagacccacaacatcccttcctttccctggcatgggccctgcagctcctggtgtttttcttggcggcctgagagccaccctcaccaccataaatctgccctgtcgacgcccctccagtcctggctcccgtcagctttccctccagctgctaatgccgacctgctaatgccatcagccacggaacactgtaatgctagacggtgtggaaactctggcccagttccctctgttactcttcatcacctcttttgagaaactcaggacaagttcctcattgactgaggcagaggtacaatcccaaaacatctgttgtgggtcct

SEQ ID NO: 262380 - DNA, 2855 bp, Homo sapiens
cctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggccccctcattgccatcctcgcctgcatctttgtcctcctagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccggccccaagacgcggcaggacatgctgcccgagatcgagagcctcttccgctacgtgcctcagacgtgcgcagtgaacagcactgtccacagctacgtgctggccaagctctacgaggccgacatggacctgtggacaccgcccttcgactccctccagacgtatatgttcgagggggacggccctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagtttt

SEQ ID NO: 262381 - DNA, 520 bp, Homo sapiens
cactacgtctggctaatatttggtatttttagtagagacagggtttcaccatgttggccaggctggtcttgaactcctgacctcagatgatccgcccgccttggcctcccaaagttctgggattacagacatgagccactgtgcccagcccgactgagagcttaaaaaggtgcgatgactctccgaaagactgagactcagagatatttggatatctaataaagtaattcaagatgcatataaatctctggtttcttctaattagtgtcttatgattgtggcttttacttaacctaacctgcaccctgattgcaaaggttttcctgactagccggttgtgtggacactgcctgttcaccttcctttagtcctctccaaggtatgtaaagttcctcacaggaacttccgaagtatatctaccccccttccagcttgaccttctttcccttttggtgtggagtgacttgagggtgtcaccataggaatactgttttagagccaccctgatcactatttagtt

SEQ ID NO: 262382 - DNA, 707 bp, Homo sapiens
agccccaggatatcatgaagtgagactatctctttggaaagggcttaagagaagggcttcccccgttctggtttccagaaatgggataaccccacggaagctctcatcctgaaggatgctttgcactcatttccaatcttcaggccatgttatctactggccctgaggcacaacgagactgcacacacagtccacgcttgccccaacagcccaggcttttctctgtggggagtcctaagccccacttgacttccatgtgcctgatgtgtgcacagagtggcatgcagaccaaagttctacgttcaaaggcatcccattctaccctctccatactcccaatgctgcaaactggtggctcacccagcacagcagcttttacatgggtttggtatgtcccacccagagatggcccatgctatgtttttttaaagtttgcatttgttgccaacatttagaactgtggtttttattctttaatctctaggttcatttcaacaatcaggcccaattcctacatgacagtgatggcccggaggggaacagcaactgttttaggtggcttctgtcctcttaaatctacaaaaggccccacagttccctgtgatacctcctcctctgacatcaagggtcagctgccactgaccactgtgcttgcatcactgtgtttcttacaatgagtcggcttcctgtgtacgatgctgtctgcc

SEQ ID NO: 262383 - DNA, 1164 bp, Homo sapiens
ggcaagtcaggctcttgacacaaatgaaaatctgtggttcaattttgtgttttgctgtctgttttacatgcctctgagtgttttatataaacacttgataataaactttgtccccttctccattaaacataaattgttccaaattgcccttatgccacacttagcaagcctcttcatttttgacttctggtaaagccagcatgaaaggagtttgatgcattttagtgtcaactttaatcatatcatgttgagtttatttataaaagtgtttctccaacttaagttctctgtgatactttttcataatttttaccatatataccacctgtgttgcctggaccatacttcgagggagcattgatttataatatgtaggtaacccagcaagaagagttcctcttgctggcccagccctagatctcttagttaactacaaacagtttttcagttgttcacattagaaaagttgcagcatggtcagtgtcacatctcaaactctttttctcctgtttgtgatttctgtctttcttacaaccaattcacatatcccttgtgtctagttctttacattgtgtttaggagcacagactctggaaccagactcgggcctgaaatcccaaattcaccacttactctgtgaacttaatatgtcttaatatatttgtgccttagctttcttatgtgtaaaacagggatgataatagtaccttcctcataggttcttgttagcattgagtaagttactatgtgaaaacttttaaaaccaagtctttgtacataagtgtttactactatttattgtttgttttcctttccagttcgactaagaacttcttgggtcaggttaatagaggtgccatttaattagagctgtgtcctttagggtcccaacaggaaacagatgctatactcaaaacaggacaattttagaagagttttttttaataaagaagctgtttacaaaggcgcaagttcagagaaacaaccctgaagggacaaggttgaggagtggttactagaaccttaaaggaaagagaatcgtgtagagtcactgccttgagagaaaccttgacctttggttgggctgatcccaaccagaagctagaaggcataggaagccctattgacacagttcatataggccagtcttctgagccagagagc

SEQ ID NO: 262384 - DNA, 507 bp, Homo sapiens
gatacaggtttgtgtaccaggattggagacccctgatgtatagtgtaacgattaagaacaaagagtctgaatccagatttcatgtgaccttgagcaagtgattaaatttctgtgcctcagtttcttcatgataacagttcatacattagaagcttgttgtatgactaaataatagtggctggtatatattatgttacacacacacacacacagagccttatgccacatattgataatgggggttcgataagattattgatggagctgaaaaatttctatagcctggtgatgtcatagtcgtcgtcttatggtattgaaacatgttactcatgtgtttgcagtgatgctggtataaacaaacctaccaagctgccagttgtataaaagtatagcacatacaattatgtatggtacataatacatgataatgataagaaatggctatgttatggtttatgtaattactatactttttattattttagagtctatgccttctgtttatta

SEQ ID NO: 262385 - DNA, 657 bp, Homo sapiens
gaaaattttgatagtgataacattgaatctgcaaagtgctttgggccatatgtccattttaacaatattgattcttccagtccatgagcatggattatttttccgtttgtgtcctctctgattgctttcagcagtatgttacagttctgcttgtggagatggttcacctccttagttagatggattcctagatatttcattttacttgtggctattgtaaatgagattgtgttcttgatttggttctcaacctacttgattgtggtgaattgagtttttgatgtgctactggattcagtttgctagtattttgttagtaagttttgcatctatgttcattagggatattggcctgaacttttctttcttcattgcatctgtgccagattttggtatcaggattatgctggcttcatagaatgaacttatttaaatataaaagagataaaagagatatacaaaagagattgtttttatagcagccagtaggggtgacccttcccttccctgcattatcccttatctcttgaaagtaactattccagtgaaaatctaacttattgctattctaaattaaaggaaccagtttaacagctatacaaatatgtttataagaaaaaatgtgtaaaatagcaataaaagcttctctaccaaaag

SEQ ID NO: 262386 - DNA, 169 bp, Homo sapiens
ggggtgaaggaaaagggttaactagtatgttggaatggaggaagtcggcagaaatgtggtgatgatcttgaaaatccccttgagtattgatatttaaaccagtccattgaaggaatgggtaatagacctattctgaaagaaatggtaagtatcgtctattttgaaaaaa

SEQ ID NO: 262387 - DNA, 400 bp, Homo sapiens
gacattttatttatttgtaaagtatttaacaataataatgtgaatatggcagaataattgacccttttcccaatttcttgtgaattaaacaattattccactttccaggtcttaactctttacctgtgatatttcttggaacactttatgcctcccccaaacccaaccttcatccttcacctgatttaagtattacataagaaattattgttcctctataatttcagtgactagaatctccaatgtccaatgaatactcttaaaattagtagtagcaagttggtcaatcttgcatttgtggaagtgcttctagcatttcatcttcaactatgatggttgatctcaatttggggtaaatattccttttttgaatcaataaagttttctttttattctttca

SEQ ID NO: 262388 - DNA, 176 bp, Homo sapiens
catcccagctgagtccagccttccagccatctccaccaaagcaccagaagatatgggagtgcagctgcctcagaccttccagaccagcctaactgccacctgaattgctcggccaagctctgtccaaattcctgacccatcgtcatgggatataataaaatagttgttttaagccc

SEQ ID NO: 262389 - DNA, 570 bp, Homo sapiens
ctcttttctctatctcttctatctattctcacctcctattatctatcgtatttctctctaacttcaccgaaactgcacttgtcaagatcttcatcacatcccagttgccaaatccaatagccttttggttctcatcctattccatctgattaagctgatgttttccctcactttaaaaatacttttccctcttgcctcccatgtctcctcaaactacatgattttacaatcctcattggccagtctttggtctccttcaccacctctttctcttgcaacccctaaatgctgagtttctacctgctcagtcccgaaccctcttttaatcctttttctaactctctcccaagatagtctcatatattgacaaagcttgaaatgccatctctgtgcttatgagtctcatagtgatgtctctaattcagaccttttctcatatatttaattgactattttgcactccactgaaagatctcacattcacttttaatataacatggcaacatggaaatcttgaatctcccctaaatctttttcaccctaacttatctctatgaagtagcacaatca

SEQ ID NO: 262390 - DNA, 357 bp, Homo sapiens
gcaggctgcactggtaccagggaagagggccaagatgtttctcaatgtacaacaaaaagagtttgaacctgtttcagaagatggccaagtatttggagatcacagaacttgacatcaccaagcataaagaagttattttgacatcctccccccaaaaaaatccctgagtattttatttggccatattgaccacaaaagaacttcaccgtggaccctactgagaatttctttccaatcagaattacctcaccattggtctgccaggatgatttatcagtaaatgtcccaagtagttgaaggaagaaagcttttatctggggttacttaataaatttcatttaaaaactaaatgactgc

SEQ ID NO: 262391 - DNA, 492 bp, Homo sapiens
tctttgcacttttctttccttgtagtgtcctgaatttggcaatgattgttcttctgtcttcatgtttgttcctaatgaaaaaatactgtaacattttttattttcttgcggacatactgattttgtgatgtgttcgtttttaccttactaaagatatgtgttttagaagaaatctcattttatttggttggaacacaaattttgtgccaaagtaaatatcttagtatttaatactgtaagcactttgtgtccttccagtccatatgccataattctttcaaactctgggaagaatgctgtggttggaagattattctgttgtatgttactatgaacgcattagtcattttgttgcattacttgtttgcctgtttttggtcactgagtaatcggtgcaagatgctttaactgtttccacaaatggcagtggcatgttgtcacagcatctaaattgttgatagtcttggattgcattaaatgcagcacatttaa

SEQ ID NO: 262392 - DNA, 299 bp, Homo sapiens
ttaggctcaattttcctacataattaagagtttggaattcgggcaatatcaagaaccacatctgtcctgaaatcaattatctctgtttggtaagtaggggagaaaatacttgataaatatttcttatctgcaacaaattctcatgttcatgttttatctttgatcttgttgaagactctgcagaaaatttctaagcaacacttgattgttttgcccacactgctctgtattttggccacaggttggagacttacttacttttacgaatataaatataatctcctctactcaaaaccaag

SEQ ID NO: 262393 - DNA, 430 bp, Homo sapiens
gtagtatttcgtgcctagcttcttttacttagcataatgcttttgacattcattcatgtcatacgatgtgtcagtacttatttttttttttattgctgagtggtatttcattgtgtgggtagatcacttttgtttctcttacaacaatcaactttttaaaaagcatatattcaagaaactgttaacagtggctgcttgtagagaagggaattagagacaaagggacaaggatgaaaaagagactttttcattgtttactatttgatatggttttaattttttgaattcaggattatgtcatatctattaaagcaaaataagaaatgtgttccccattaatatatacaaaataagaggggagagccctctgctgatccaaatcccatattcctttaggaaattaccattaatttatttttgatatatttct

SEQ ID NO: 262394 - DNA, 448 bp, Homo sapiens
ggaaacctactttgaagttatccccactattattatgggggttaaggagctagtagatttcaaacccgtagagcagggcgtggccatagtaaagatttcaataatatcaacctgtatttagtatttctatgtgacagatgatgttctagtaccactattctaccaaaggccaagcatatgttcttcacagagcccacatctgtattttgtggtgatttattggaatcctatatgagagtgtgctttactgagaatgattatgctgggtttctgaaatcaaggtttagatgtaagaatatttggtgggaaaattatgaataacagggagcttcaaacttctaaaaataagtttttaaacggtgaaagctaacaagaagctgcaaaaatgtctttgcctgaaataattgccctgggatggtgagagagtcatgttaattctcgaaagcta

SEQ ID NO: 262395 - DNA, 462 bp, Homo sapiens
atatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaa

SEQ ID NO: 262396 - DNA, 318 bp, Homo sapiens
ggaatcattacatgtgcttcctattttcttttgatgtagaactacaggaatttaagaaattatagaaaatttaactatactcacaaagagaagtgaaatgcaaacagaataatcatctatattatttagctgaaggcctctaaatttcaggcagaatatttggggtaggaaataatatgaatgtagtaaattggtacaccacattaatatatagatgtaataatgtttacttaataattttaagaagattgtggaattggtctttagtaatatgattttccaaattccttttaaaaaaatttacatttatgagtctct

SEQ ID NO: 262397 - DNA, 84 bp, Homo sapiens
  misc_feature (2)..(2): n is a, c, g, or t
  misc_feature (15)..(15): n is a, c, g, or t
anagcacaggcaacnaaagcaacaatagacaaatggaactgcatcaaacttaaaatcttctacacctcaaagaaagaagccagc

SEQ ID NO: 262398 - DNA, 395 bp, Homo sapiens
taaattcgcggccgcgtcgactgttcattaaatgttagtggcagaggtaatagtagttgtaacgttgaattgcctggtatgatggagaatgtttctaaagaacacccctcaaggctgggcatggtggctcactcctgtaatcccagcactttgggaggctgagactggctgatcagttgaggtcaggagttcgagactagcctggacaacatggtgaaaccccgtctctaccagaaaatacaaaaattagctgggtgtggtggtgcacgcctgtagttccagcttcttgggaggatgaggcaggagaatcacttgaacctggaagcggaggttgcagtgaactgagattgcaccactgcacaccagcctgggtgacagagcaagactccgtctca

SEQ ID NO: 262399 - DNA, 446 bp, Homo sapiens
tgaccctgactcgtagaaccaaagaaggcttttgggagggaatgaagtcgaatttgagaactgcacttggcaagtggaataggagttagccaagtgcaaggaagggtggtggggaccaggaattggactgagtagagaacatgcactctcaacaagggcatgatctcccccaggagaagaaaatgggtgcttggcagacaagataaatcttagctatcacactgttttgtcaccatccaaagctcaatcctatgtgacaaaattgtattcctcttaatatttaattgaggggagggaagatgactaggaaagaatttctaagaaggtctccttaggtgggcaataataaaaaaaaacattgagaaacattggtatagaaagagcatttgggcataggaaagatcacacatgaaactactgaaatgagagagaacatagactatttg

SEQ ID NO: 262400 - DNA, 313 bp, Homo sapiens
ggggtaaatactgttaacttcaaacacagattatcatgagaaaaaataggatgtttatgaaagtactctaaacctaaaagttctatactaaaaaaacatggtatttaatgaatgtgcaaggggggaaatcctcatataaaactgaagttcttcagtgaaattccaaagacagccttacttattacttctctgtcaaaagaaggcttgcttacttctctgtctaccatctaccacctttcttagcacttgtctggtaacctccacttaaaatatggggacccctttatttttttattttatttttatttttgag

SEQ ID NO: 262401 - DNA, 740 bp, Homo sapiens
agtttgagaccagcctgggcaacatggtgaaaccccatctctactaaaaatacaaaaattagctgggtgtggtggcacgcgcctgtaatcccagctacttgggaggctgaggcaggagaatcgcttgaacccgggaggcagaggctgcagtgagctgagatagcaccactacattccagcctgggcaacagagtgagactctgtctcaaaaaaagaaaaaagaaaagaaacttggaagccatttcagaaagactccaggaaggccagcagccactcctgcacaaccaggaggaagggctacattttactgcaagcagctgttttctctgatccttctttgtaaggaagtgcagtgattttgtgttttgaaggaagacttgaagaagcagttgggtaggtattccaataggactgatggggaggaaatcagatactccatgagaaggatttcagacctggtagagtcagaatacattctgctttcaggatttttgagattgctgatggtcccagggtttatacaaggacttggatctggctatagaaactcaggtagaaattacatgtatgcagatcagcactgatgttggttctaatctataatgatgtgataaattaaaaaaacaaaacaaaaaacagggctgggcatggtggcttacactataatcccagtactttggaatgccaaggcaggagcatcatctgaacccaggatttcaagtccagcctaggcaacatag

SEQ ID NO: 262402 - DNA, 347 bp, Homo sapiens
aaattgaaaactttcttgaaacaaatgataatgaaaacacaacacagcaaaacctatgggatacagaaagagcagtacttttttgcctacgtcaaaaaagaactcaaataagccacccaaggatgcatcttaactaggaaagcaagagcaaaccaaacccaaatttagtagaagaaattataaagatcagagcagaaataaatgaaatcaaaacaaaagaaacaatataaaaaatcaacaaaacaactgaactcagggagagagaatgcagaaggatggttaccagaggctgggaagggtagggggatgattggggaaacgtgggatggttaacggattaaaaaaaa

SEQ ID NO: 262403 - DNA, 426 bp, Homo sapiens
tgatcctggaatatctcaacatgcagataacaaggaagctatcaaagttatgtcaaaaggattttgagagactctgaacaaccaaaagggggacaatttgagattcaataaagataaggatgtcaatgaattgaatccatcaagtgtgttaaaatctagagttcatattatagtgtctgcagatgtatattttgtgaaaaaccatacagaaatgcaaggaagcgatttctattacactatgatactctagatagtggttacttttggaaggaggaaggggctgtgattaggaagaggcacgtggatggcttccggcctggctgcactgggtggtggctacaagggtgattgccttatgataattgaccgtgtcataatttgttttctgtaactgtgtttcattttaaaataaaaggtttaaaaagt

SEQ ID NO: 262404 - DNA, 312 bp, Homo sapiens
acactagtgtgccagcacatgagacactagaaatttagtgcagaagtctgtgcctttttcgagtgtatgtgtgggcatttttctggggagggatttatcagattatgcttggccaaaagtgccaagtatgagatgccaattactcattccactgtcccatatagaacagaactaacacaaattgatagtgggagatgtgggggatcttggtggttatctcaagaatcaaccacagcatctagtgctgagccttcataattatacttatcatcaacctgaagatttttttataataaactaatacacccctgt

SEQ ID NO: 262405 - DNA, 545 bp, Homo sapiens
tcgttcttcactgctatcatatgttgcatctgacctagatgtaggcttgggatataagaacagtttctgctgtgctgtacaagctctgaagcaattacagtacccttttcagattgagggtctaagaattagagcaacaactgagcaaaatgaacacagctttaggtacttgtgggacaatataagaaaagtctgagatatatacgtatttatctcagattcacatctcagagggagaatagagagacaatggggtataaaacttataaataggtataaaaacagcaaataacaaatgtagcagttttaagaaatctcagaagtctcataaaattcttttgtattcatggaaatgcaaacaaagttagcttcttcttattctatgtttatttgtcaaataatttgtgaacattagcaaatcagcacagtgctagaaattgtgggaaaaaccaagatagtttaaatgtttatcttgatatgcaaaaataactgtaatacaaataataaataccctaagagaggtagagtgatggaaatgtatagca

SEQ ID NO: 262406 - DNA, 252 bp, Homo sapiens
tagaatcaaaattcaaagtaattgtcagcggcttggaagagaatcacggaattctctttcaagaaatgctgctgggcacggtggctcatgcctgtaatcccagcactttgggaggccaaggcgggtggatcacttgaggccagaagtttgagaccagcctggccaacatgagggaaccccatctctactaaacatacaaaaattagccgggcgtggtggtacgtgcctataatcccagttacttaggaggct

SEQ ID NO: 262407 - DNA, 323 bp, Homo sapiens
gagatctctcagagagaggttaaatgcacaggctctgggggcaaccagcctgggtttaaatccccgttctgcctctttgcaactgtgagaacttgggcacattattttctctctctgggcctcagtttccttatctgtaacacagggggaatgatcacaatgcccaccttgtaggttatgatgaggactaaatgagttcatgtgtatgtagtttaaattcagtgcctacaccagatagtgagtatatccaccatgctgaacacgcaggacttgggggatggggaggggaagatggcatcattaaacagctttgtttccatctc

SEQ ID NO: 262408 - DNA, 638 bp, Homo sapiens
atttggcataacgtttttattgcaggattcttaaatatatttaggtactgtcttggtagtcatcagacatatgtatagatcatacacacacacacacacacacacacacacacatatacacatacatatttaaatcaccggctactgtttgcattcagtgcacattatagctctcagaaggttgcaaacacttttcattgttgccttttatctgtcatgctgttcaaataattttcctggacactactaaagtaggaaatggatacaagtaaattacaacttgtacccatttccaactgtcaaaaaaagcactaaaggagaaatagaatatggacttcataaaacgttgtgatttggaagcagtttttgtcaaattagtatatgtaaatcgtctttgttttgtgaaactttctctgaggttttgcagtgtttacaatgtagttgactcacaaaagtgatacagtgttgaaaccaatagcagagaattttcagaatgataaaattcattctaactgtggctgaaagagacagattgtatgtgagttcttttttaatatttgaagatgatatgtttcattcaggacattacattttaaagggtttattatacatttgtaggaaagtttaacaagctttaa

SEQ ID NO: 262409 - DNA, 411 bp, Homo sapiens
gctgtaccagtagtaccttaaaatgcaaatgcaattggtaaagaacaaggcagcatgtagtgcttgcacttacaaatactaccagttttgtaacaatttgcatttttttttgtccttgaaagagtaaccacttacctaataaaacgaatatttaaaagcgcaatattccttcctttgcatggcatgcaggaatggtgaaagcaaagaaacagtcatcccttctcttccccccacttctggtctcccgaaaaaggaatgccaggtcagacaggtggaggagggaaatggggcacaggtcaaggtatgatgaatctcttaaaaagaaatccggccaggtgcagtggctcacgtctgtaatcccagcactttgggaggcagaggcgggcggatcacgaggtcaggaatcgagac

SEQ ID NO: 262410 - DNA, 290 bp, Homo sapiens
tgatttcagcacttaagctacaccaccagaggaaacagcagtgaggagaaaccaagcgcgatcatgggacaagaggtcttttcttcctgtcttcatctgctgatctgctcacctgatattcactgagcaccaagtttatgccaggtaattgcactaggtgctgaaaacagaatagaaccctggctaagaggcccatttcagccctcatggagctttgaattaattgttgatgtatacttttttttttaacctctaaattacatcattttattgtcataatgactagccat

SEQ ID NO: 262411 - DNA, 186 bp, Homo sapiens
caaatgaggcaattagagtgggttctattcccatcagactgtgcccttataagaaatttggacacatgcacagataaaaggaccatgtgaagaggcagcaagcaggcagtcatttacaagccaaagagagaggtctcagaggcaaccaaccctctgctgatgcctctaccctgaacttagaacctc

SEQ ID NO: 262412 - DNA, 359 bp, Homo sapiens
agcctcccctgctcttagtctatgtgattcggacacagccaactacatttcccagatccagaaatgaacacgccattccaagtaaagccaatgagagacagctgcaggacttttgctggaactattgggaaagtggtgtttctttttctgctatggttacttatctgctatgctctaagcctggaactgctggaggtcatctttgctgcatgaaaatgaagtcaatattgaggacagcagaggtgagagggagagaggcataatcctgagtgtattgcaggggcacctggatccagccatacctgaaatccgagactttccattctaagaaccaatacattctctttgtacttaaaaaa

SEQ ID NO: 262413 - DNA, 455 bp, Homo sapiens
ttataggattagatgagaaacaatggctgacactagagtccacaatttctatataatatctgaaggtcagagatccaaaatgcagaaactagatgactgacttatgagactggttgatcttgactgtggatattagaaaacttaaaataggggagactttcaaatggaattgaggtgaagtatgtgtgcaaccagtgtaaggagcagatgtttgcagatatttcttttatttttatttttgaaacggaatctcacactgttgcccaggctgcagtacagtgctgtgatgtgggctcactgcagcctccaactcccaggctcaagtgatcctcccgcttcagcctcctgagtagctggagctataggtgtgtgccacaatgctccgctaattttttgcattttttgtagaggtggagtctccctgtgttgcccaaactgatctcaaactcctgggc

SEQ ID NO: 262414 - DNA, 639 bp, Homo sapiens
cgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaaggtaagaaattttaagcacataagtgccccattcatatatttgcagcattaaattgaaaaataaatacaaaa

SEQ ID NO: 262415 - DNA, 1308 bp, Homo sapiens
cgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaagaaattctagagagatacacatgaaactaataaaagttattacctttgatgggagaagaggaatgtgatggatagaggcaagggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactccta

SEQ ID NO: 262416 - DNA, 1226 bp, Homo sapiens
cgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactccta

SEQ ID NO: 262417 - DNA, 353 bp, Homo sapiens
ccttcacctgctaccactgcacccacaggcagaaggatgtagaagtgcataaaaagtcacacttctctgtcttttatcccaggagagagtcaggaacagtgagctcctacataaagatcaacatttgtttctcctttccctcctgcaagtgcctgtctctgccaaagatttcagtaatttctgctgcagcaatgggaataatggctgcactggcctgcttctatcaaacccaagcagagcagggtctgcaacttccctttgaaacaagggctgacgggaggcggaggttgcagtgagccgagattgcgccactgcactccagcctgggtgatgacagcaaaactccatctcaa

SEQ ID NO: 262418 - DNA, 457 bp, Homo sapiens
caaagtacttgccctcatagagcttaaattttagtagtggaggtagagaagaaacaaaataaataagtaaaataacatgtaagggataagtgctaagaaggaagaaaaaaagcaggaaagggggatatgaaatatttcagggtaaggtcttgacattttagattagggttgccaaggaatatctcacagagaaagtgacttttgagtaagcacttaaaatgaatgagagggcttgacattcaggtatctggaggaagagcatttgaggcaaagggaacggcaagcacaaagggtcagttggaaatgtgccctgatatgttctaggaacaagaatttcaagagctggctggtcgcggtggctcactcctttaatcccagcactttggcaggccggggtgggaggactgcttaagcccataagtttgagaccagctgggaaacaatactccttctctac

SEQ ID NO: 262419 - DNA, 480 bp, Homo sapiens
acaagctgtatgtactctacatctgagcagaaaattttaatacagctgcatagtttgcctctgtcacccttgagtttctaaactctgccatatgaaaagcatgccacaaatagtagctacttttctagcctgggtcacagaaaggagattcctggaatgaagtgaaactgagctgagcctaagtgaacccaggagaacatagcaggccacggttctcatgtaatggaagcaaggaacaaaatacattttgttgtgaacaccgagatattggggttgttacgatagcaaaaacaaatctgagaaataataaacatacagaatgaattattgaaactgacccaatagtctcatcaatagataggttttgtttgcttttttgtttttgataaacatagaaattgacccatctggtcttaaggcttgaaacttatatttaatttatctgagttccttcctcaggaaatgaccttcaggcttcta

SEQ ID NO: 262420 - DNA, 418 bp, Homo sapiens
gtgtgggtgagtaaaaaaatatttaatatatgttaattaacttccgcatctcctgaccccactaaggtttgaataggagcctccccctttataaaccctttttatatacccacactacctagcctaattggggcacatattagctgcttcatacatacttttcaactgcctaatttgctgattaggcataaaagtatataattctggaaaagtctccacaaggtgaaaatgattatccaaataataaaggcccacaatgccagtgagtacattatctgcattatgctgatatttgactcctttcaactctctttggttgtagaaacatgaccgatgattatattacacttttaactctttaaatattattagcttgctttggactgtggaaaactaactacaatcatttttattcctc

SEQ ID NO: 262421 - DNA, 510 bp, Homo sapiens
tcttttcctaaaggcaatctattaataaaccacccaaattacatgcagttctagtgaccagctcttactctctaatactgtgcccaaataaaaggaaccagggcttctcagagaaataactaattgtatggattggccagggtaggtacaagatgaagcagtgataccttgtgtgagggaataaaaaggaaatgctcaaaaaaatggtgagagtatatgacaaagatccagaagctagcttaaagggaactctggccaaatctggggaaatttgaacacaaaaaatacttatgtacattaacagagtacaaacgattgaaaatacagcagttcatgagtccttaccaaaaataccaataataaattcataaatcaatgaaaatgaaacaaagcaatctcttgcttacagtaaaatgtcaacaaccatctagtaaatgtgaagggagtgtgctggaggtagaaaatcattattttgcaaccattatgggaaagactgaatcaggtaaaaaa

SEQ ID NO: 262422 - DNA, 459 bp, Homo sapiens
tgtcacccaggctggaatgcagtggcacagtcatggtccactgcagcctcaacctcctgggctcaagctgccctgcctcctcagcctttgaagtagctgggactacaggcgtgagccactgtgcctgggcagagttaactctgtgtgacgttgtgtctccattgccctctgtgggttcaggaacaccaaccgcacagctgcaatgttccagtcgttagctaggctctttcgtgtggcctgctccatttaatcacctcggtaaccccttcatagaggaggaaacagaggctaggagaggtgaaaagtcagccgggggcgcacagcaatcgctgccttttctcctccccaggactctgaagggatcagcactgctttccaagtccaagttgtgctgcagcaacttcacaaaatgccacttttatgcatttataaacaccaagtttaacaaacacgtgttga

SEQ ID NO: 262423 - DNA, 548 bp, Homo sapiens
tccttctttttcaagtatacttcatttaatgcaaagattcaaagtaagactccacaaaataaccctttagatctaaatggatttaaacacaatgaatatcaagaagtggtctctattgacaaatgcagaaaaccatgctatcatccagacaacttaagcagaactggctaaatctgtaatatttttgcaaaaccaggcattttgttagtatgcagaaaataaatctcgggaccccaaaatcactaagccaaagggaaaagtcaagctggtaactgtgtcaggcaaacttgcctcctattttattcctaagatagcttatctttacaggtgtgggacagaaagtcctccttctactcacctgagacaagtgtttatctgattgcttcctctgccccattgtttatgtaaaaatgcagactcactgagccagattaaggcataaatgactattcctgtacctgcctctcacaagtaaattgtgtattcagtgaaaggcagatcaaagactcaaaagaatgcaaccatttgtctcttatctaactgtaacc

SEQ ID NO: 262424 - DNA, 764 bp, Homo sapiens
tggtataaatacactgtctaaagcatttaatggtctttctttaacacagccaactcccccgggtttgaaacagtgttaaattctctcttgcttgtggcaaaagaagctgtcaagtccaacactgaaaaattggtaccatttcctggccagtaagcacagaacagaggggctaaatattttatggttttattcatttactgtgttctcatgctgtgtttttcttttctctgtctctccctcctgctcgtgtctgcccagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 262425 - DNA, 1362 bp, Homo sapiens
atggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 262426 - DNA, 598 bp, Homo sapiens
gctggaagaacaatgcaggagggggtggcatctccttcagcttcagcagtgtgccgagaagagggctaatttgaggaacaggatggtggtgcggagccctggcctgagggccgaggcagaacttccccttttcttgggccttggcccgttacaaagaggggtgttgcagcagctgatgcaaactgagttcagtttccctggggagcagaaggactggtacccggcagaggcgatgagacaggccgctgatgatgcacaggacttgcggtacatgatccctgtaacacagacccaaaggagctgagttaacgtgcaccggcaaaagaatagctgtccctctcagcccaaatccaaacggacagctcttccttactcctcccacagcccagagactaggtgaggtcagggaagtgcttcggattgtctcattgatattcaagatagatggtgaaagagacaggcactatttcattagttttaacaaaactgttccaaaagcgatttgagatgccaatacctgtgaatacctgttaataaagagctgttaaatagacttatttacattttaagtcagagttcacactgtgtacaagacaca

SEQ ID NO: 262427 - DNA, 294 bp, Homo sapiens
gggtacttggtatatggatagagtcactgaggaactggatatttatttatttatttattgagactccatctcaaaaaaaaaaaaaaaaaaagtaaacattacattccacgcccaccaccaaaataaaggagtggtattgttttacacttttgcaaatctttttaaaatctgacctaataggttctcacatgtgcttcggcattcggtctgctgcaatatattgcattggttgacatacacattgtgaagaacatctgcagttatgtagttcacaaagagaggacctgcagaccc

SEQ ID NO: 262428 - DNA, 812 bp, Homo sapiens
aggactggactccccagtcccgcttttgcctgaagacttcgagggacgcagttggagcgcaaggctcctgcttggcggtgaggcagagggctaacgaccttccttctcctaaattcactgatgcggcggcaagaatggcaccgcctcgtagagctaccgcatttcccaaactcgtagtctcaggaccactttatactcataaaaatgagggccccaagcttttgctaatgtgggttacagctatcgatgttaccacattctaagttaaaatgctttaaagttttttgttgtttcgtttaaaagtaaacagccgggcgcggtagctcacgcctgtaatcccagcactttgggaggctgaggcgggcgtatcacctgaggtcaggagtttgagaccagcctggccaacatggtgaaaccctgtctctactaaaaatacaaaaatgagccaggtatggtggcgcaggcctgtaatcccagctactccggaggctgaggcaagagaatcatttgaacccaggaggcggaggttgcggtaagccaagatcgcgccattgcactccagcgtggacgacagagtgagactccatctcaaaaaaaaaaaaaaaaaaagtaaacattacattccacgcccaccaccaaaataaaggagtggtattgttttacacttttgcaaatctttttaaaatctgacctaataggttctcacatgtgcttcggcattcggtctgctgcaatatattgcattggttgacatacacattgtgaagaacatctgcagttatgtagttcacaaagagaggacctgcagaccc

SEQ ID NO: 262429 - DNA, 273 bp, Homo sapiens
gtggtccacagagtatttctgtttgaatggaaaagacagtgggctacccatgcccaaccctgttcgctccaatcctcactaactaggtgctttcctggcttcagagcaacactaacattcccatgaccccaagcaaccaaggcagctgggctggggacaacaggatatgatacccagggacatctgatccacacactctgctcccaccaggaaacttccaggctgggattatctgtccacttttgtccatttgtataattaaaaatcgagtct

SEQ ID NO: 262430 - DNA, 694 bp, Homo sapiens
ctgccctgaggcctacccccataagccagtgccttctgctacccagaagccgtgacccttcctccagccctgcactgtccaacaacttgaaggctaagggttggcacagcaaaggtattctgcatccttgatcttgagctatcatcagcatccattctgatcagctggtgtccatgaggcagcaccagttgttaactctgttggttatcacctctgcatcttccattctttatactgagtcccccagctatggtgattggtttaaaggagcaaaccataggttcaaataaggaattaatgacaatctaaataaatgagggggacagctcagtcctcagctattgcttctacaaatccaccaagaatttcttcatcaatatggttcctgttccctgcaggtccatctccattcactaaagcagttcagaagtgggtctttctcttcattgccttatttctgcctatgacctactcagaagcaagttcttaattattattagctcaactgatttattttgcacagaaatacacaatttactgatgtatacaaagtgttattgagagacaggactagctggatttcctaggccaactaagaatccctaagcctagctgggaaggtgaccgcatccaccgttaaacaccggcttgcaacttagcccatacccgaccaatcaggtagtaaagagagctc

SEQ ID NO: 262431 - DNA, 462 bp, Homo sapiens
attcttttccctatggatttctagttgtttcaacatcatttgtggaaaagattattctttccccatttaactgtgttgacacctttgtcaaaaatcaattgccacgaaatgtaagaacttatttctggactgttgattctattccactgatttatatatctagccgtatgccagtgtgtctggaactggtgggttcttggtctcactgacttcaagaatgaagctgcggaccctcgcagtgaatgttacagttcttaaaagtggcgtgtctggagtttgttccttctgatgtttggatgtgttcggagtttcttccttctggtgggttcttggtttcggtgcctcaggagtgaaactgcaaaccttcgcagtgagtgttacagctcataaaggcagtgtggacccaaagagtgagcagcagcaagatttattgcaaagagtgaaagaacaaagcttccacag

SEQ ID NO: 262432 - DNA, 601 bp, Homo sapiens
gtgaatcatgtgtgcatgtatataagtgctgtcatttttttaaaagtgcttcttgtggagtttggcaatatttttgttgtattttgaaaattcactagccactagaccttctacctttgttgataaagcaaattttggagttgagtaaagtaagctagtataaaagaaataaggctatagcaggcctttgaaaatatttatggaactatgtgttttaaagtaactttaagattatgggcagtattatgcagcatttttagaatgttactcaaagtcatagattctgagtcatttatggtaaagatgccaaaattactttttttctgatattttcctttaaattaaagatctgttttgatgccatattgagtgatttggcaaaataaaatctgttttgaatgatttgcttctatattttgagctgagatggaaatcaatagctgttagaatagacagtatctgtatatatcagccttttcaaagtaattattgtatactttgtgtagagtaagaaacatttaaattgttgagaggttatacttgaggtaagaatttttaaaattttcagtaaggacttaaaaataatgtctgaatattcaga

SEQ ID NO: 262433 - DNA, 286 bp, Homo sapiens
ctaacctggtgggaaatgagacaagagctgccagctgaggactcccagacaaaccaatccgcattcaagccaccaggagactacagccgcaagaatgagtccatacaagaccagcacgagaacctcctagctgagtccagaccaacataattgacccactaaacataaaacaataaaataacttggtttcaaaccaattcattttgaagtggcctgttatacagaaataggtagctaatatactaggtattaaatatttattatttattaaaatgataattgtttt

SEQ ID NO: 262434 - DNA, 308 bp, Homo sapiens
gggctcaagtgatcctcccacctctcagcctcctgagtagctgtgactacaggtgtgcaccaccacacccaactactttttgtattttttttgtagagacagggtctcactatgttgcccaggctggccttggactcctgggctcaagcgatctgtcccccgggcctcccaaagtgctgggattacaggcatgagcccccacccccctccccagtctggccagtgtgtccagcttttctgtccattcaccttccttcagctgctcacccctctcttccctcacacagggcatcctcctctgaaaaaaa

SEQ ID NO: 262435 - DNA, 394 bp, Homo sapiens
atacatcctgaaggaattaggggtgaagtagcatgatggctacaattcatttgtaaatgagtcatcaaaaaaacaatgtgtcggccaggcgtggtggctcacacctgtaatcccagcactttttggaggccagggaaggtgggttgcttcagcacaggagttcaagaccagcctgggcaacatgtgcagaccccatctctacaaaaaatacaaaaatcagccaggcacggtggcatgcacctgtagtcccagcaactcaggaggctgaggtgggagggtctcttgagcctgggaggtggaggtgggagaatagctgaaacccaggaggcaaaggttgcagtgagcttagatcgcgccactgccttctagcctgagcaacagagcaataccctgc

SEQ ID NO: 262436 - DNA, 417 bp, Homo sapiens
gaaaaaatgcgttccaaaataaaataattcacctccagtaaattatatagttagcacagaaacatacataaagaatgaaacagatattttcaaattcagcttctgcttttgatagagggtaaatctgaggaagacttttcagggctatggagcacaatctgaattgttttgtgggaaccacttctttctctctggctacactggcctcaaatctgttctacaagcatgtgaagataatctttgggttttcaaatccttccagcactacccgaccaccactctgggcagcatcaccgccatcaccaggaccaacagccttgtcgacatgaccacccgctgggagcaagaaacaggtggtctcccctccatgaggctgtgaggacaaataaatgttacctaagcaaagtgaaagagaca

SEQ ID NO: 262437 - DNA, 388 bp, Homo sapiens
ggagacagagcaagaccctgcctcgaaaaaaagaaaaagaaaatttggaagatctgacaacagttgacctgcattcctgctcggcaacagcctgatggtggatgggcagaggctcagttgtctgccaaacctcccatcactgatgtcttccctcgctgtcatcatctgcttgacatgtaggcatttggtgtgtgccttctgctctgggtgcccagatgaattggatgctatatgagaaaacattctgtaaatgtcttgtggtaggcaacctcaaagatcactggggcctccaatgatccctccttcctggtattcatgcctgtgtataatcctctcccttgagtgtgtactacacctggatacttgcttctaataaacagaacacagc

SEQ ID NO: 262438 - DNA, 482 bp, Homo sapiens
atcccattcattaggagttgatgtttgccggtggctatcctcatgctttgtgttcagataaactctatacttaatcataaattctaaatgttattatttactgctgacatcagtttctgtcacattgtaggagcctcaccagagagggcacctgtagccatgttgtaaaactcacacttgtcaaaaagacatgggttagtgtttctccccctccctctgcatgaagctaattagctgacacagatggtcacctccattaccaactagagccaggatgaactatgtgtgaccaagggtgttgtcaagtccttttccctgaggactgattagtgtttatcttgaaaacatgtacttaatgggttgtatagaactgtgaagtgtctttctcttttttcaacctcttagctgtttgcctctatttcccatcacattctggtctaaggcttacttattaataaaatggtgtttatttctttctctat

SEQ ID NO: 262439 - DNA, 1099 bp, Homo sapiens
  misc_feature (1004)..(1004): n is a, c, g, or t
  misc_feature (1050)..(1050): n is a, c, g, or t
  misc_feature (1090)..(1090): n is a, c, g, or t
caaaggtctctggttttcctaggcagaggagctccttggattttcttatctccatgagttccaggttctgctgtttgctctgatcctgttgatatatgtgctgatgctgctgggcaacctggccatcatcagcttcatttgccttgattcccgccttcactcacccatgtacttcttcctctgcaacttctccctcatggagatggtggtcacctccactgtggtacataggatgctggcagacctgctatccactcacaagaccatgtccctggccaaatgcctaacccagtctttcttttacttctccctgggctctgccaacttcctgatactcatggtcatggcctttgatcgctacgtggccatctgccaccccctgcgctacccaaccatcacgaatggtccagtgtgtgtgaagctggtggtggcctgttgggtggttggtttcctctccattgtctctcccacactgcagaaaacacgactctggttctgtggccctaacatcatcggccactacttctgtgactctgccccgctgctcaagcttgcctgctctgacacccgccacattgagcgcatggacctcttcctgtccctgctctttgtgctgaccaccatgctgcttatcatcctctcctacatcctcattgtggctgcagtgctgcacatcccttcctcctctggatgccagaaggccttctccacctgtgcctctcacctcacagtggtggttctgggctatggcagtgccatcttcatctacgtgaggccaggcaagggccactccacatacctcaacaaggcggtggccatggtgactgcaatggtaacccctttcctcaaccccttcatcttcaccttccggaatgagaaggtcaaggaggtcattgaggatgtgactaaaaggatcttccttggagacccagcagcctgtaggtgagagggtgagcccttgacagggctagagagcacctgacaagtcacgaggagtagacttnctgcaggtgggcacccacatgcctaagctgagctcctcactctctnttttctcattttctcctggtccctcatcttcatgcaagtntcttctcct

SEQ ID NO: 262440 - DNA, 420 bp, Homo sapiens
cctgaagctgtgccctaatttctccagaaggctggaatacaaacacagaaacgcacaagtactggccagggtcaggcagagagtaacaaagcaggggagttataaccagcttgctgtcctggacaccaagaagtggagctacagaacagcagaggctgaactgtcgggtgacttgcaattttaaaaggtagtatttttaaacactgtttaccaccaggcaaaacctattaagagcttacagaaaaggtcactgcagacaaggttctcaaccacggctgcacactggaatcacttgagaagctttaaaaacatgactagccgggcatggtggtgcatgcctgtaatcccagctactcgagggaggctcaggtgagaggatcccttgaacccagttgctcgaggctacagtgagctatgact

SEQ ID NO: 262441 - DNA, 404 bp, Homo sapiens
ttttgtccttcctccttctcctccctgtatctctgttcctggccttttaaagtcctccattacccatggcctgtggcctctccttttaggtctaacaatggacaggattccaggggccttaattttggtcatagcctctgctctgccccagggcgcagccaaagtcggattgtgccagggtttgtttatgctggaccgtgtgcccagggagagctgcgaaatctctttctggggaatggatggttctggacatgtttgagcaggactggcctgagtcaaaattgagagggagacagagtcgttatccctttctgttcttattttggggcggtggggaggatcacttgaagccaggagttccagaccagccttggcaacatagcaagacaccatctgtaccaaaa

SEQ ID NO: 262442 - DNA, 581 bp, Homo sapiens
tagtgatgtcgtagccatcataacattgtagtgcactgcattgctcatgtttgtggtgatgctggcgtaaacaaacctgctgcactggcagtcatataaaagcctagcacacaattatacacagcacattatacttaataacaataataagctactatgttactggttcatgtatttgttacactttttattattactttagagtatagtcctacttattagaagaaaaaagcaggtcatttagaaggtattccagaagaagacattgttatcatgggagatgacagtgccatgcttgttactgcccctgaagaccttccagtggtataagatgtagagggtaagacagggatattgaggattctgatgctgtgcaggcctaggctaatgcaggtgtgtcttgttttctaacaaaaagtttaaaaaataaaaataaaaagctttgaaaatagtaaaaagcatatagaataagcatataaaggaagtaaatatttttgtacagctctgtgtatttgtgttttaagctaagctattacaagaacccaaaattgaaaaataaaaagtttataaagtaaaaagtg

SEQ ID NO: 262443 - DNA, 298 bp, Homo sapiens
caacctgctaccagcccagaaccttctggctgggtcttttgggtccagaggctctaccatccctcctcccagaggcccggctgtgcaaggcaggagccctgtcttgggcttggccagcctgcctaggatcgtgccctcttcctctctctgcaggctgggctggtcctggttttgcccccactgcaggattactctcttacagtgcccaaattagaaataatccacatgtccagcatgggagatagttaaataaattaataatataccaactcagtgggaaacgaggcagcttttattt

SEQ ID NO: 262444 - DNA, 378 bp, Homo sapiens
ctcaggaggctgaggcacgagaatcgcctgaacccaagaggcagaggttggagtgaactgagatcatgcctcttcactccagcctgggcgacagagcgagattctgtcttaaagaaaaaaattattgggatgttagatttatttttgaaatgagatctattactgattatcaatagacgcttcagtttatgtaacttagtttaaaaattctttaaacaaatccttgagtgttcatttagaaaagtaatctctaggctggatgcagtggctcacacctgtaatcccagcactttgagaagccaaggcaagagacttgatcccagaagttcaagaccagcctgggcaatatagggagacggtgtctctaccaataaagag

SEQ ID NO: 262445 - DNA, 454 bp, Homo sapiens
aactcccttctctctattcagattccctgcccattttttctcctaatgagacgcctgacttcctacctcctttttgaaacttcaaactgcttagcaaatacaattttgaattgagtttgctgtcacagaacaaaaactagtccttggtccagagtatcttgcaggactgaatcaactgtggtctaagacacaataataactcttaattattttcttgtttccttcatggtatatttgttgctggatgatgagtttatattatggttgaatttcctttttgaaatgaaaagatgaatagtctttattggctgggtatctatttttatccagaagactttgcaaatgagaaatatttctacaatctgagtttaatttgcttaagcaatgaacttgttctttaaaagtcgtatatgtgcaaaataaatttaaattaaataaatcatattttaatgta

SEQ ID NO: 262446 - DNA, 456 bp, Homo sapiens
atccctggcctttggtagtttccatacagttatgtgctaattagtactctggcaaatagtcaaatactcaggagcactctgtgtagatttctgggattatttctctgtggaattctttactttttagtactctgtcctataagctatagcagcattgattttcctagatgcttagttctgtcttctcagcttcatagagtttggccccattttgattctccttcctttactgtggcctggaaactctgtcaaggaagtaagctctgacacatatcatcacgtcacttgcttcccatctatcacagattattgtccttcattacctgatgtccaatatcttgaaaaccattggttcatttattttatctggttttttgtttgctttggatgaaggggttaacccaacgacctggttatttttgttttagatacagattttatttaatttacttatgt

SEQ ID NO: 262447 - DNA, 419 bp, Homo sapiens
gactctgtgggctctttcatctcataatatattttgctcataatatttaattgtaaaaacatatgtgagaaataataaatcagtctatcttctacatgttattcatttttcagcacaccatttggcctgacacttcaaatagagtagacacctaaaataacacacttttagttttaaagaagtaacttataggtcatcagtattacctaaaatagattaaatactttgaacagtaaaggatttcatcactgtcatcctatacttaagttgtaagaattattttatcatacagaaatatgtcattggggccaagtgcaggggctcacaccagtaatcccagcactttgggaggccaaggttgggagattgctcaaggccaggagttccagacgagtcaaaaccctgtctccacaaaaaaa

SEQ ID NO: 262448 - DNA, 316 bp, Homo sapiens
tgcccagctaattttttgtagagacgggattgcgacatgttgcccaggctggtcttgaactcctgggctcaagtgatcttcccacctcagcctcccagagtgctgggattacaggtgtgagccactgcacctggctttgggacatttttaatttatttttgctggaggagagggtgtgtattctatgactgaagcctataagggccagcatctgatccctgctgaggtcaagttcagtggggacagggctgtagtgagctatgatagtgtcactgtgctccagcgaccctgggcaaaaaagtgagaccgcgtctca

SEQ ID NO: 262449 - DNA, 390 bp, Homo sapiens
gaaactacatattaatcctattacctaaagttgatcttaaaaaatttgtcacctactgatatggtttggatttgtgtccccacccaactgtcatgtagaattgtaatccccagtgttggaggagggggctggtgggaggtgattggatcatgggggtggatttctcccttgctgttctgagtgagttatcacgagatctggttgtttaaaagtgtgtagcacttccccctttgctctcttcctcctgctccagccatggagcagccatgctctcttcccctttgccttccaccatgtttgtaagtttcctgtggcctccccagccatacttcctgtacagcctgcagaaccatgagccaattaaacccgctttttttgtaaattacccag

SEQ ID NO: 262450 - DNA, 459 bp, Homo sapiens
accgctccttcctctgttgaagaccgccctgcctgctcttgcacccagccacttgtaatgtgggacatctctcaccccaactttgtaggtggagcaactgctacagaggtaaatatgattaactttacattccatctttcgtctgctcccaaacttaacagcaggtaatctgcttctagcaagtggtgaaggtaagagaagcatctgtataggaggcaagagatctgagtccttttgaaggcctatcctctgctctgtatctcaattactgttcttcatttcaattattcttacctactattcagttcccttgatcttttcttcttgggggctgtcttagggtcagggagattgcagaagcaccagaactaggagcagccctgagacatggggagttggagctgaaggaggaatggcaggatgaagaattccctaggtgaggacgtgtgagggtggctg

SEQ ID NO: 262451 - DNA, 226 bp, Homo sapiens
gctgggacaaccagctccccaacaactcctaggtgtttaaagaaggaggcaggaagacttgtgaagatgggaactatacaagaggcaggaaaaaagacagatgttggggtcagggagattgcagaagcaccagaactaggagcagccctgagacatggggagttggagctgaaggaggaatggcaggatgaagaattccctaggtgaggacgtgtgagggtggctg

SEQ ID NO: 262452 - DNA, 917 bp, Homo sapiens
aagtaagatcttggctcacttgattggtaacagtgaataaacagtccggagagacttccccaccacccagctcttactgggtcaaatctcgggttcctcaaggagacaagactgtaagagagtttgcagagaagagatgagggtggttttaggtaggaaatgtcagtatggtatggaactggggaacaggattccaggataattccctggtttaaaaataaaggaagtttctgtaatatgttgtacctgataaatctgcctgtgttcttttattttctaaccctcaccctccagaatggccatcaggaaagctgaaccagaaccgagtttaggtccaggttctcgttctggcaaatctttctccttaccttcttcctccacccctccacttatgccatgttttcccttagccactccccagctcggtggaggaaaggcaggcctaactaggtaccgtcttcccgactttgctcaatgatagctgggtgggtctagctgggttccagccacttgtaatgtgggacatctctcaccccaactttgtaggtggagcaactgctacagaggtaaatatgattaactttacattccatctttcgtctgctcccaaacttaacagcaggtaatctgcttctagcaagtggtgaaggtaagagaagcatctgtataggaggcaagagatctgagtccttttgaaggcctatcctctgctctgtatctcaattactgttcttcatttcaattattcttacctactattcagttcccttgatcttttcttcttgggggctgtcttagggtcagggagattgcagaagcaccagaactaggagcagccctgagacatggggagttggagctgaaggaggaatggcaggatgaagaattccctaggtgaggacgtgtgagggtggctg

SEQ ID NO: 262453 - DNA, 672 bp, Homo sapiens
tctagattatcagtctttttaatttcatgtgtatattggtatcccactgtggttttaatttgcatttccctgatgactaatgatgtttagcatcttttaacatgtcatgttccatctgtgtatctttttactaataaaaataaagtgtcttttgtttgtacattttaaattgggtttttatgttttattgttgagctataatggatgtattttattggactatattgttataatcaatgttatggagttttaagaattctttatatattctgggtaaaagtcttgtatctgaaatagttttgcaaatattatctcatagtttatgccttgacattttatttttataacaatgtctttcaaagagcagacattttatattataattaattctagtctatcaatttttttcttctgaggttcatacgttttgtgtcctaagaaatctttcctactgcatgatcataaagatttgttcctacattttactctggaagcttttcttagaattcctaaacaacacatgtgattgtctagaagttttatagttgtagctttcacatttaggtctatgacccattgtaagttaacttttgtatgtggtgtgggatatgggtcactgttcaggtgtttttcatgtggacatccagctgccccagcatcatatatcaaaaa

SEQ ID NO: 262454 - DNA, 457 bp, Homo sapiens
tataacccccttttgtgaatgagaaaaccaaagctcagttctgtttatagtttgccaaggctacactggtaagtaaagggttcagccaatgtatagacagactgtatagatatatgaagtgggggtgggggccaaggagctattactgctgtttggaaatacttgcctcttgtagatccagctttaacatttttatgacatcctagtaatagcagaccctgcacaaagtggatatcagagttaatactgtgaagagacaaaataatgagaatacttttaccaaagataatgaaatcttgcataatgtctgcatttttccattgattggagtgcatccttagaaaactgaaaataacaaaaacccaggacatttttggaaattgtatgctctctagcaactttgcgtgaatttttatacaaacacttatgagttatataaaatgttctaaaactagaa

SEQ ID NO: 262455 - DNA, 277 bp, Homo sapiens
gatcggccggacccctagttagaagttaatagcagaccctgcacaaagtggatatcagagttaatactgtgaagagacaaaataatgagaatacttttaccaaagataatgaaatcttgcataatgtctgcatttttccattgattggagtgcatccttagaaaactgaaaataacaaaaacccaggacatttttggaaattgtatgctctctagcaactttgcgtgaatttttatacaaacacttatgagttatataaaatgttctaaaactagaa

SEQ ID NO: 262456 - DNA, 335 bp, Homo sapiens
aaaaaaaaagagaattcagaacaaaggcatcactcgccccttttggggtgtcctgttttctttgtggagtttcaagtcataggcagattcttcttcagtctaaagctctgttttcctgtattgcatgacctgacgtttttggctttggggtaccagagatgaccttgtactgtgagaggatttgaccttggcatgtgtaattgtggacaacagctacaaagttaggggtgactgagcacagtttacagggagtagtcttggctgtttttctttctctcctagaaagttgttgtttagtgatcctaattctagtttggagatgcattctaaagggc

SEQ ID NO: 262457 - DNA, 700 bp, Homo sapiens
ttttacttttttctcttctttttttgacacagggtctcattctgtcacccaggcttgagtgcagtggcacgaatacatcactgaagccctgacctaggctcaagcaatcctcctgcctcagcctcctgagtaactgggttacaggtatgtgccaccatgcttgagtactttttaaagtttttgtagagatgaggtctcactatgttaaccaggctggtctccaactcctgggctcaagctatcctgctacctcagcctcccaaagtgttgggattacaggcataagctattgtgccaatttttttaagactaggaaaaaaatacacatttagccaaattaataaaaatcaaatttatcaaggaaaagttgatattttagcaactggggacttttttaaaaaaatcatactactctgtaagaaactatttagtcagttgacataatttttcttttgtaagacatttgtaattacaaatttttcctgtatctatgtatctattatatgcatatataatacatacttatgtatactaggttatgtagattattctacatattataaacaagtaataggtactttagtattataatagatttgaatgatttcttgatagaggaactgctattgtaagtgactctcatcaaagagaggttgattagcaatgtatgcatatgaaataccttaaaaaagggcccaag

SEQ ID NO: 262458 - DNA, 551 bp, Homo sapiens
tttcaatcagactcactactactgcttgaggagtccgttgacataatctctacatcatcttcattttctttattatgcccaggaggttccaacaaaaagtcactactatgatttggtggtaacatattcatcgacatgtcatttgactgccatggatactgtggagcaaggacatctggagaaaaaaagaagcatagataagaacagctctatctggtctcattctgtcacccaggcttgagtgcagtggcacgaatacatcactgaagccctgacctaggctcaagcaatcctcctgcctcagcctcctgagtaactgggttacagatattccaaccttgtcatctctggaaaaccctgatctgtttgaaaacactcttcggcttaacattacctggcaatcttcctgctgcaagtgcatctcctggtaaatggccattcacgccattagtggaaggattgttcatctgacccagtaacccacttctcatctctaaatcagttgggtagggtctccgggggtcccctaaaacaataaagactgcatttaa

SEQ ID NO: 262459 - DNA, 545 bp, Homo sapiens
tctctcacatctgtcactaacaatgaaatacagaaaagcatattatatcttacctttgtggttacaatgcacaggcaatccattactctaccattacaatattttatacataaagcaaaactattttaagttgcctagttgaacaaaacatgtaaataaaaataaataaagctgtgagataaaaccataaatgaagaagttataactgtaactagatctctccaggatccattcttagaggtagcaatttttctactatctaaaatacaagaaaccagagtctgtcacgtgccctacaatcttctttatgtaatctgtatctgaagaacttgaaattatcccacaaaacactgtggaagatgtcagggtttattccacaagagtccactgcttcttcagatgctgtttcattaatccctcttttcaagatatgaggttgacaggaagtcatctgatgaaatgctccacaaagaggttcccccgatataaatttaaatctgcttctcctcgttagctacagtttggatactcaaatgacaaccacc

SEQ ID NO: 262460 - DNA, 740 bp, Homo sapiens
tctgtggagtaaaaaagagcgtaattaaaatactagcaacattttacataactcaggaaatgtatatgtggggaaagtgtccgggagcacttagaagttagtgtgagtgctccaagatcctgatactctttaggatggaagttaagataatgaatgactttagatgttgttaatctaagtacttaacagaaaattttcagataacctttaaagaatagcaatacaatataactttcaaaccagtagagaggaaacattctgaaataagggaaaaacactttagaaatcccaactttgatagaccacaaaaatgcaagaaggaagaaaaagcatagaaaaagcaaagaaatggcatagtatataataaatggttacaataaatataaattgcctatctcaccagattaataaaaaaaaaagtctaccttgttcaatatatacagtttacaaaagacagtacaaggacagagaaagacaaaaagtagaattagggaaaataaaacaagcaaatatacctggttaggatagctgtatcagtattagccttacaaatattaaagtgaaaagcattaataaggataaggagactctcaaaaataataaaaatttcaactgaagtaggtataacagttctaaacaaagttattaaagtaaaaatgtagagggcaaaacggaaaaaaaaaactattatgttgtatttgaagtcactcaatttttagctcgagcagcaaaaaagtaaa

SEQ ID NO: 262461 - DNA, 416 bp, Homo sapiens
atcctcacctcctctggattttcacatcctccagctggtccagcatgagctctggaggctaaggaaaggcaatgcagtagcagaaacaagctgggctggcatttctgtgcagtttgttcagcacgctgaatgggaagcgcagggtaacagtgagagcacgaatcaaagtttatcacctgtggggtttcagctcctgtatcactgggttaggttttgagaatgctgaggtgaagatgacatggagcctgccttcaaatagatcacactttagcagaggagatagtgtgacttgtagacagctgcatccctagagttactttagagagccctgtcgttcccaagcagagagatttgtctgcacagccagcctctgggtgaagtacaaatgcaaaataaataaatgccttcttctagaa

SEQ ID NO: 262462 - DNA, 954 bp, Homo sapiens
cacaaacacacacaccccatgcacaccctcactatgcaccctccttcccaggcaccagcttccttctttgagagtcagtgcaggtcactggttaaggcgtgggttcgggatctaatatctggggccaagccttagctccatcgctctttttgtgagctcttagacaagccacttaacctctctgtgcctcggtttcctcatctgtgagataggaagactctaagaagagtcacttccatcaggactgtgaagatcgaatgagataataacatttaagcacttcgggcagcctctggcatgtgatgggccccaagtcaatgctaaccaccaaaggccatgacctttggggatgtgtcctggctctgaaaaaccatatagatgggtctcaggggtctaagtgggggaacaactgctgcgtttggccccagatttggggagcagcacctgttgttgagggacacctcctcagatcaaacttccattttttccagaaaaggctgtcatcccctctttagggccgtgctcattttggctttccgaaggtgaagggccaggtgccttcagcatctttctgagcactgtgacatgcagaggatgtggggtgactgcagctaggcggacttggatccgggggaggccctcagttctctgagccttggtttcctcatctataaaatagggataaaagtttctttcccacatagctcttctgaggcttagatgaggcgatgctggtggggtgtttaacacagagctctgttagcataatggacacttgtgtctgtcttcttataactcatttaatgaatgaatgaagtttgcaccatttgttcacctcctccagtcacctttcaaattagccaacttgcaaaaccccagcagacacactttccttctgtgtgtaatctcctgagccacttcctgtgtgttggggaggggaggggggatttctgc

SEQ ID NO: 262463 - DNA, 434 bp, Homo sapiens
atatatataaagtactttgcacagtgcctggctcctggttggcgctctgtgaagcttaactgcactccagcctgggcgacagagcgagactcttgtctcaaaaaaaaaaaaaaaaaaaaaagaacacagattccttgcctgggtcccaatgctgactgtgccccttaccagctgtgtgaccttgggccccaagcaaagtgccccaagcaaagtggacataatgaaagtacatatagtcagcctgggcaacaaagtgagaccccgtctctaaaaaaaaatattaaaaaattagccacgcatggtggcatgtgtctgtagtcccagctactctggaggttgaggcaggaggaccacttgagcctgggagttcaaggctgcagtgagctatgatcgtgccactgcattctagcctggacaacagcaataacttgtca

SEQ ID NO: 262464 - DNA, 286 bp, Homo sapiens
ctctcttggataaaattacttactgcaatgagttttttcaacaatacgtgagttcctggtggtcagaatacctggacccttctctattgttcttggctttccaggactcagccaaaacagaggcttaaagtcccccaacttaacattctcccagtgtagcctgggaaatcaacggaagaaatgctgctcgctggagttccttcttgagagttgcatgtacacagtcctagtaaaggctctgagaagtccttcagacaaaaagttattaaattctatttaacccagt

SEQ ID NO: 262465 - DNA, 278 bp, Homo sapiens
tggaattccattaatcctagaatttgtctgcagtcaactatcagattttttttttcccctggctcctgctgctctgggtttgcaggtttcagatttgcaggataatatcactcatttactcccacaaagagtttctcctctgttgtgttcagttgcaaactataggatacttcccttgacttaaccttgcccatgccacttctagcagaaatttccaaaagtacctggatgctaatgatatcattctgcatttattaaaaactgatttgaaaaataaa

SEQ ID NO: 262466 - DNA, 447 bp, Homo sapiens
aaaaatctataattttaattatagctgtaaagtcccttttcctatataatatattcaaaggttgcaggcatttgggtgttgacatctttgatgggcacattgtgtctaccacaggctatagaaagaacagagaaatttgtccaagataagatgattaggttttgtctagataggggcccttgctatgggccctcagtttttaccttaatgtaacagaacatgagaggagctttgacacccaccccaaaagagtcaacttcattatgctggcaaaggcatgggtacaacctgctctgtgatctaccttctgaaccacacaagcttgtcctgaacgaggttggggctgagtctgttgataacagacccccatttttgggcagaaaaaacagattctgtatgatctacagtatttaacattgtggcaaataaattataaaggaaaaatgg

SEQ ID NO: 262467 - DNA, 506 bp, Homo sapiens
atatcgaagtcctttctacattccagtaataactggactacagttgttgactacagaacatatattgcacgttggttctgttcactattaagaatccagcttaatacgaaaaatgaatatagaatctacatacaatatagtaatcattacaatttgtgtatgtagctctccttgcatcttcttgtcgaagtaagtggtaatgattctgtatgatatatttttatattatagactgctagtgggaagacttaggcatgtcaacttttcctttgtgggagaggttaggaggctgagtggatgatcaaaagtgctgcaacacagagatcagctgagtctgaaaggggaagacaatccattgtgctgattataagtatccttccgttctagataggtataagttttaattttacactgggttggagaactctaaggaatttagacatataagttatttttcttattcaactttcattaaagaaaacagttgtaatgttttgtttgtttgt

SEQ ID NO: 262468 - DNA, 775 bp, Homo sapiens
gccgtgggtcccatcaggctttcccctcggatcctctccaggatgaaccaggacttacctgaggttaccaagtgaacttctgggaaaagtccaattctcagatgctagatgtcttccaaaaatgaagcaaatttgtaacttagtagctgagtcaagtattcctgttagatggtcaacattaattttttattttattttagtatttttaagtggcaactctagtgtgtaagaaaatgaatgcgacagctgaatttgtagaaagcttctctgactctcttgggctctgtcataagccctggaacgaaataaaagtctagtgaatacagggaagcccccttctttttctccatatttacccctcaccttaaccataatttcacataattaaccacatttaaggtggttgataataaagtgggaatgtacaggattctttttaaccctgagttagcaatccaaaaattagaatttgttgcattcctagaactaagttcagggttcctgagcaggtactcaagcagacacaaagacaaaacttccattttatttcagaagaacctccataatcccgtgagtcagttcccttagtaaattatgttgtctatctatctatctgtctcctattggtactgtttctttggagaaccctaatacacacactcttttttcctggctctttgagtataagatgattggccaggattaagaatgtagcctctgcactgagatagcgccactgcactccagcctgggtgaaagaggagactctgtcaaa

SEQ ID NO: 262469 - DNA, 491 bp, Homo sapiens
ctccagaccaaaatcccatgagctgcgttcaaggtggtttccctgcagctgctcctctctgtgttgcaaaatgctggccccgtattcaggactcacgagatgtccatcaatgcaatcaagcaatatctctgtgtggccttgtccaaaaacggcgtctcttcagtgcctgatgtctttgagctctctcttgccactctttcttattctacttggtagtctttcttgtaataataatgcattaaatggtaaattactgaccttatagtatatttataccttcctgaacatgaaattaactattaggtaaatgactttggtgtggagaaaatttgattaatgttctgagggaaattttctttacatataactaaatttcttaagctaaagtacaaattgtttccatcagttccgaacacatttagaaaatagccagtcaccatctaccgtgtaagagttttatttattagaattccattattaattcacccttc

SEQ ID NO: 262470 - DNA, 446 bp, Homo sapiens
cttggaagaacctcatatgccccataaaggaacttttctctgaagtagaggatcgctttttgggcccagactcctttgagaaaatctggaaagccaaggtctgtcttcacaaagaagtgtaagggttttcctaggatctcgctgagagacagtacaacgaagtggatgagcgccccagtctctcttaccagcctgtgctatctcccattgtgtgatctcggtttcttcatctgtaaattagatgcatccacctattcggtgtgtttcggggagtgaatggactaatgtatggaatgcaatcgtaagaaaatcctccacgtattaaatgccttgcattagttaggcacttttattattgactgccatggatgctggtttagaaaaagaccctatattatttcccttttagtgttgagacagtgaacgggctcattccttttccatat

SEQ ID NO: 262471 - DNA, 422 bp, Homo sapiens
aggaaatctgtcagtgcccatcatttcctcaccaccttatcctctcttctacacaaagcccaaatcctgacacctaatagactatctataggaccatatgctgtgcagttgcactctcagaaggggcacatgcttggtttaatcctctgctgttgctgtcttggaattcttagtgattttatcttcgaatttgtgtttggtaagtgaagccagtgagacaatgaagcatgcacatgagcagtggaaacaccccagcggggaacgcatgcatgtgtgcatgattcagggcagtccagagtgcagctgagccagtacctgggcccagttgcagtggtgatggtggcgggcagcaggagtaacagtcaggacagcaatggctgcggctccaaagacaggaaagggctctgcatatggacattgcc

SEQ ID NO: 262472 - DNA, 405 bp, Homo sapiens
gggtccagcctttccatggttgcttgcagtatggcaatggatgcccaaatgggctgcctcccgggggcctacattaaagctcttgcagtggcaaacagtgcctggccatcaagagttccaacagaatggcccctgtctgatgaagtgcttttgctggcaccacacatcagaatgttgtggcctgtggcccaagaacactttagcccaccagcacagcagatttctaacctcaaggggccagggaacaaagctggggcaggataccagctctccagagttagagcaccctgcccaggagtgctgagctgagctgtatagccttctaatttctttcagaaacaaagtcagtaaactgaagccaccttatacaacaattaaacccctgacaaaatcaaataagataaa

SEQ ID NO: 262473 - DNA, 318 bp, Homo sapiens
atttatccacttttgtggctgcaaggtgattataacttatttctcctttaggctaatgattacaaaaggtataaattctagatttaaaatctaaagaaattggtatccatggaatttggtcttcactaatgttggaacatatcgaagtgataaattcccactttatcgctattgattaatgaacaacattaagaaaatgataaaatgtaattactattaccaccttaacaactgagttttcatttttgtaaatatgtggagttttcatttttgtaaatatgtggtcaagctttagggattcaagaatcctaaaataat

SEQ ID NO: 262474 - DNA, 455 bp, Homo sapiens
atttcagcctacctttcaacatgctactcacttggggataggagaattctgtcattttgttgataagtgagtgtttcaaaatgactgtctactcataagttaattgtgagcatatggagagatgacattcattgaagctagtgtgtgtgtatctctctaaatccttattcttaaaatgaagggtcccctgcaaagattattggaagaaagtcagatgacatagtttctaaaaactttatataacatggctatgtaattaaattaatttccactaaattatgctagctcagacatttgacttataattgtgcaattgttggaaagccaaattacatcaggttgcacagacagcaagttattaaataagacattagcagatatcagatgttattatctgtttcttaaaatgttctgttttgtagaagttaagcatcaaaagtttttgtatcactgag

SEQ ID NO: 262475 - DNA, 302 bp, Homo sapiens
gaggtgacttgcctaagccaccctgcgcgtcgatggcagcacccttatgggcccctggtttgcagattcccagcccagcatgctgctgagggtgcagatggcccggggcacctggctctccagctttgctgagggctgccccatacaccaaaacaaagctgggactctcggctgctccatttgggcactgccaacccatttattaatgtcacaactagagaggtcccaccacacaccactgcctgcctgccttgccctctgggcttagggaggcaagtataaagagaagagagaaaagaagg

SEQ ID NO: 262476 - DNA, 414 bp, Homo sapiens
taaaaacacattgtagaaattaacgacgtgattttgtaatggagcagaaaaagaaaacctctaagatggagtgagcgacttagggatccctatgtagtcatcacagatgcctgtctattgataggaatcctgtttcaaacatggaatttaaatttaagagaaaggtgcacaccaaattgatgcctggtttttctggtggcttgaaagaaagtaatggagtttttaaaaatgtgtgaacaattgatatgaaatgctcaatgtgtatacaatcatttatgtggcaggcaatgcactgcatgctggagctaaaagagaaagtccgggggctttccatctattgagggaggcagagaaaagagtgatacaaagggattggtgctacaatatgcaacaagaggtgggaatgttaaaaag

SEQ ID NO: 262477 - DNA, 692 bp, Homo sapiens
ggccaggtcccttgaggaaggactccactacattaccaacaatttatgcagtgaatcttcctcccaaccttctgcaaggagacctctggccttttaccagggtaactgtgcactgaggaaagggaaatgaatcagacatatcagggactactggacaccggctctcagcttacgttgtttccaggggatccaaaatgtcactgtggtcctccacttaaagtaggggcttatggaggacaggtaattaatggagttttatctcaggtctgacttacagtgggtccagttggtccccagactcatcctgtggtcatttacccagtgccagaatgcataattagcatagacatacttagcaactggcagaacccctacagacaccctattaagcaaattgtactggaataattggcaagctgtatgtagcagagtgatactggatccttatctctaaccttataaaataagtcaactcaaaatggatcaaagacttaaatctaagacctgaaaccataaaaattctagaaggtaacatcagaaaaactcttctagccattggcttaggcaaagaatttatgaccaagaacccaaaaacaactgcaacaaaaacaaagagaaatagtgggggcctaattagacaaaattattttaatgtatcaatgaaagctttcaacttatttttctctatcctt

SEQ ID NO: 262478 - DNA, 118 bp, Homo sapiens
tgggaaattctgtactgacatttgataacattcagtattcagaataccagttggcagttgacactcaaattgagaagctgtgttcaatatatgatatttgtctttttctactaagaaa

SEQ ID NO: 262479 - DNA, 425 bp, Homo sapiens
gtgtgcttttgtgtgtgtgtgtgtgagagagagagagagagagacagagagagagaaatgttgatgatgggtagtgaggtaaattctggtgcctcaacaatgagtttctacacagaaaaccacagttattaagttgatgtctgtggagctctatgaagtctttatgtgagcttcagtgggtccgtggatcctctaatattttgtgtgcatgcatatatgcctttttaggggagagagttcattgcttctaccagattctcaaagggaaatatgaaatttctcccaagaaaatcctacctcctgtggtataatggttgcccaaaatgttggttgctggatgctttctacttccttaaggaaaagttaagacgttttgtacctactttcaggcagtcctggcatgtatgggccatggattgaacatt

SEQ ID NO: 262480 - DNA, 176 bp, Homo sapiens
attccagaaataaacaattcataagttttaaattgcactcggttctgagtagcatcattaaataccacctgggacttgagtcatcccctttgtccggtgtattcgcactatgttacactattccccaaccctcattccttactgtataggaaaaaacagtatgtatagggtttggt

SEQ ID NO: 262481 - DNA, 517 bp, Homo sapiens
cggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcaaaggtatga

SEQ ID NO: 262482 - DNA, 443 bp, Homo sapiens
ccaaaatggagtcattcaagctgaagtgtcacattatcaaactaaaacctaaattgtttacttgtaagatctgaccttccaggaaatcaggaggaagatgatagctaaatctccaaaacaggctagttttagctgatgtgatgaagtcctctctgttttaaccgatacaaggaaagtgactttaaatgaccaatccacattttgttctttgtttctgccttctttagccttttcctgtctataaagcccatcccttctattcagctcagcagaacaactttctttctttcttttttttttgacacagggtctcactctgttgcccaggctgaagcgcagtgactctatcttggcaacagagcacctttctgttttgtagatgggatgctgcccaattcatgaatcacaataaaaacaaatgagatctttacaactcaatttgt

SEQ ID NO: 262483 - DNA, 277 bp, Homo sapiens
acatacttcacattgtccttacatgccacagtggcaaaaaaaggaagtgtccccttgatgattccagaagaaaagcactaggtcagttgctacggtccaaagataggatgatttgctggagctgcatatcatgcccacctctaggcctggggctaggaggtcagtcaggcccagttggtgcccatggaaatggctctacaagaaaacaggtgctcaagaggagagctgctgaacaacccatcaaaaaatggccactgcatacatacctgccattccc

SEQ ID NO: 262484 - DNA, 633 bp, Homo sapiens
tctcgctctgtcacccaggctggagtgcagtggcacgatctcggctcactgcaagctccgtctcccgggttcacgccattctcctgcctcagcctcctgagtagctgggactacaggcgcccgccaccacgcccagctaattttttgtatttttagtagagacggagtttcatcttgttagccaggatggtcccgatctcctgacctcgtgatctgcccacctcggcctcccaaagtgctgggattacaggcgtgagccaccgcgcctggccgcatatatattttatacaggtgtttctgcatgtatctatactaatataaaaagcacactttctggactcctgggtaattttaagtaaggagggattcttttctttttgataatagactgggtctctctgcctgtccaggctcttcagaatcatgcttttgttcagtctgacttccttgttctcctgttctcccttaagctaccgttctacccaaaactggctagaaggcctttctgttttccctttctgtgtggtagagacttcacttaaatcataaactcaatgtctttatatctcctcaacctcactagcacagatccccaaggctttactcaataggtaaagggaagcttctagaatt

SEQ ID NO: 262485 - DNA, 360 bp, Homo sapiens
tgtgagaggtagaggagtcagggttgggctggaagagacagaatttgtcactttaatccaacactgaatgccaggagacagaggtgaatggttacagtcttggtgatgtggctgcgtctgtgggaggatgtggatggatgatgacagtgatgaactggccaggcctgaggcaaccctcccacttagatttggcttttaaagtcttcaagctcattgagggcagctcatgagacctcttgactctgggtccactgctcctttatatacacatatatgtgtatatatatgtgtgtgtgtgtgtatatctatatatgtgtgtatatatatgtatctatatatatatctgtgtgtgtgtaactg

SEQ ID NO: 262486 - DNA, 216 bp, Homo sapiens
tctggaaaattcaggattatctccatttcaagatccttaaataaccacatccacaaagtcccttttgccatatgaggtaatagttacaggttccagcgattaggatgtgtgtatctttgacagccattattcagcctacttcatatgttattgatttgtacacttgtttgctgaaaagataaatataaataaatttttaaatatttgtagaacata

SEQ ID NO: 262487 - DNA, 438 bp, Homo sapiens
agtttctaatctttttctttgcttcagtttcactttgggctttggggtaatagattccatatcaatatatatctaaaaaatgttcacagttcttagttgggagaaataaaagtagtttataatctagtgggaaaaatatagtctttgaagtcagtcaaactagactttcattttttctatgttaacgtgaataagtaatttatcttccttaaaatgggtatgaaattacctttctcaccggaattttgtggatatttatgattagatatatgtaaaatacttttgcaaatatttttattagtagttgttattaaattcacttaaggggcagccaaaaatatcaaccttttttatagtaacaaaatgaaccaacacttaaggtaatgccttaacatacaaagtatagtacttctgcattttttagtttgttgcatttcc

SEQ ID NO: 262488 - DNA, 588 bp, Homo sapiens
atgtgagggtctgttacactgaaatgcatattgagtcaacaaagatgtagaaggcaagtcttttctcctgtagcaaaacttgtgttgaatccacgcacaggttatgagtgtatacatagataaatgactttttagatactcactgcgactcaatagatgggacaccctcaagttttagaggatgttgtgggaagttacaagtacagttggccctgtgtatccgtggattccacatctttggattcaagcaaccacagcctgaaaatattaaagaaaaatagatgtttatatctgtactgaacatatacaggcttttttttgttattccctaaacaacacagcagaatttatagagcatttacattgcattattataagtaatctagagatgatttacagtgtacgggaggatgtgcgtgggttacacgcaggcatttacaccagggacttgagcatcctggattttggtatcggggagtcctggaatcagtcacccctgtcccacaaaggaccattgtgttcaactgtttttgatcaacataatggcaaattgtatgactcaatagaataaaaaaagtgcttggaaca

SEQ ID NO: 262489 - DNA, 1472 bp, Homo sapiens
gtatgtgtttttaaactccaatgatataagctgtaattataatacaaagcaactaaattaattttaattattccaaataattagcttttttcataaaaagctagttattccaaatattagcttttttcatgaaaagctagttattccaaataattagcttttttcataaaaagctagttattccaaataattagcttttttcataaaaagctagttattccaaataattagcttttttcataaaaagctagttattccaaataattagcttttttcataaaaagctagttattccaaataattagcttttttcataaaaagctagttattccaaataattagcttttttcataaaaagctaatttaaatttggggcaagtgtattattaatggtacatattgtattaaagtttgtgtaatgtaatataaagtggccacattacaaaatataggttgtttcagcttgcaaaattaaacaactgtataaaacaaatttataactgattgctagtaagaggtaccatgtaagaattgtgtttccagctgaatgaagaaattttaaaacctggttccatatattacaaatcatgagccaggactttggtaggggaggaattgggggctttggctcccaaaaatctctgtcacataccccctccccaccacaagtacacaatctatggaaaacttgtgcttatcataattacagctttaagtaattttcccttctctttggatattgtatatttgcatattgaagaggttcaaaacaacagtaataacatgcatattaagagaatttgcatttcataaatagtacaagatagtactaaaaaattggacatttgaaaatatgaagcaactaagagttgcttaatgagatgtcatttcctaacaggatgttcatttatggtttttggctactattgctctttggtgtgtttgtggaatagaaattattccaagctattgtgaagagtcaataattaaccaaatgtatttatttcctaaaaagactaaaactgaaattattatcatgtaaagatggcatctgtcctaggcaacttggctttatgcagtttgtcctttcagttttcaggaatgagacctcttgacccctcccctccaatgcagcccctactaagggggagtttaaggagccatacatagttctataattcaaatcaagtaaacatgcttcttgtcccaggttaacttgtgctgcctcagtcgctgtttaaacatttttatacgcactgttaacctgcctgcccattaccctattacttttaatggataaactactgttccctgggcagttgtctcttttaacgtcccaccctaaacttgccaaccctcatatgaaggcctcaggcttgttattggcaaaggtcagaagtcttaagctagtgaccttgcaggctaaagtaggccttgaatttgtttgaccaggaactaaattaaaaaataaa

SEQ ID NO: 262490 - DNA, 481 bp, Homo sapiens
taacttgaggcctgtttccattgactttatacaaatggaatcacatagtatatactcttatgtttatataacaatgttttaatatcaccttcatcactgaaggaaaatattgctggagatagaattctgggttgacagttttgtttcagcacttcaaagatgttccactttcttttgatctccactgtaaggaatctgtagttgttcatataatttcccattctatgcaatgtgctactttgctcttcaatatcttctcttcatcttttggtttcagtagtagtctaattaaatgtttaggtgtggttttctttgtatttattctgcctgtggttcacagggcttcccaaatctgtaagttcatgtctttcaccagaagtgggaaaccttacagccattattcatcaaatatttatcttgcctcattctctagctcctttccttttgagactccaattatgaacattttaggccttttgct

SEQ ID NO: 262491 - DNA, 640 bp, Homo sapiens
ccctcatctgatttaccatcctgtgaatggccctaggcagatagcataggtgattgttgttactgttttgagacagaatctctgttgcccaagctggagtgcagtggcatgatctcagctcactgcagcctctgcctcctgggttcaagtgattcttctgcctcagcctcccaagtagttgagactacaggcatgtgccaccatgcccggctaatttttgtatttttgtagatactgggtttcaccatgttggccaggctggtctcgaattcctgacccaagcttaagctttggtcaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactaaaaaaaaaaaagtcgacgcggccgcgaa

SEQ ID NO: 262492 - DNA, 5482 bp, Homo sapiens
  misc_feature (673)..(673): n is a, c, g, or t
cgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagtcatgtttttggctatttgctcatttagtcattgtttatcaaccaaactaggtaagccaaggagttacaagacagctctagagaagctccctctgcttacaggacaataatgcattgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgngcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggacgatctttgaggaaacagacctggagggaggtaatttaaggagggaaagtgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactaaaaaaaaaaaagtcgacgcggccgcgaa

SEQ ID NO: 262493 - DNA, 5641 bp, Homo sapiens
  misc_feature (673)..(673): n is a, c, g, or t
cgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagtcatgtttttggctatttgctcatttagtcattgtttatcaaccaaactaggtaagccaaggagttacaagacagctctagagaagctccctctgcttacaggacaataatgcattgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgngcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggacgatctttgaggaaacagacctggagggaggtaatttaaggagggaaagtgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactagacagcacagcttactggactggatgtaataaaactgactgaaactatagaaaaaaagaaaagaagataagaaaagtgagagaaggaaagaaaagaagagaaaaaggagaagacagaggaggaagagaataagaagaatgagaagaaaaaaaaggaagaagagaagaggagagaaaggaaagagaga

SEQ ID NO: 262494 - DNA, 566 bp, Homo sapiens
aagagtcagggtcttactctgtcactcaggctggagtgcagtggtgcaatcatagctcatcactgtagccttcaactgcctggctcaagtgatcctcctgcctcagcctcccaagtagctgggactacaggcatgggctacactacccaactaatttttaaaattgttatttttgggaatggggtcttgttatgttgcccaggctggtctcaaattcctggcctcaagcaattctccctcagccaccagagtcactgggattacaagtgtgattagaccatttttaaaacatcgttgcttttttcctcaatgatttgttacagttctttcaatattaatcattctctttatattatatgccaggcaaatttctgctttcaatatgtgacttgtctttttactttgtttgttgtcaattttttctttaagtcaaggtctcgttgtgtcacccaggtgtgagtgcagtggtgtgatcttagctcactgtaccctcaaactcccgagttcaagcgatcctcatacctcagcctcccttatttaacttttgacataaccactgaacatac

SEQ ID NO: 262495 - DNA, 700 bp, Homo sapiens
aataaagttcaggagaagggtcaaataatgcagacttgtaagttcctgttaattcttgactatacaattgattccattttgaatgtttaacacacagttgctcagcagtctggatgttactgtattcccccacaaagacagctctgtaaatgaacataaatcaggctataagagaatatctccttacacttggtcttcagggcagaagtagcaacaaaaaagcacaagtcctctttgaaaccatatcttgatttagtgtcctcagcctaacaggtattgcagtgtggcccaacagagatgggtctgtgagatacttcaacacccggcagggctgctgggtctaacattggagtgttgggctgcagacactgactggggagaaatgttgtgaactttatttgcagttctgagagaaatgctgtgttgaaacaggagaggttttcagaagctgctctcagtagctggctccaggattggggtgatggtataatacttacaaaaggcagcacatcagatagagaatttgataggcagaaattaggtagctccggcaagttatttttcaatggaagactaaggggtagatccgagtacattagcagaaaaagttctgtgatttagattgggaagttgagttagaaataattataaaagcccagtcatgtgtgaacttagaccagtgaacagacgaatgtactac

SEQ ID NO: 262496 - DNA, 298 bp, Homo sapiens
acctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttccagctacttgggagggcgaggtgggagaatcacttgagaccaggaattcaaggccgcagtgagctatgattgctccactgcactccagtctaggtgacagagtgagacattctca

SEQ ID NO: 262497 - DNA, 339 bp, Homo sapiens
atacgagtctggctgatttgtccaaggtaaatactactatggcctacttatccattaggctgaatgggcaaagtaccgagagcccacagaaatgttttctttcaaaataagaaaatgaattttaaggtcaaagaaacttaatatcgtagtctactggcgagtgtataaattgatataatcacttgggaaaactatttggcaagatctattgaatttgaatatatgcatttgctataacctagcagttccattcttacctttaacccaaatgtaagtgtatacatattcaccaaaatacatgaatggggatgtttgtggcattgccatttttattggaaa

SEQ ID NO: 262498 - DNA, 289 bp, Homo sapiens
tctcaacaatgcgttcctacagagctggagtccacgttgaacagctggctaaagccaatgccaggcctaatttggattattaagggctaattatccaggcttcagtgcaaccactggccttggccaagtgctcaacatggactcaagctctgcgggaaagaaatggcaggaggctgtgcagctttagttttgagtagaatattcattttcagccctgatgtgggggcagcctgttttcacaacctttaaagattgaggcagggtcagaaaagagagagaattaagccag

SEQ ID NO: 262499 - DNA, 6643 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtacccaccggagcctccctacagcacacctacagtcccctcctcctcagggcgcctcaccccctcccctcggggagggcccttcaaccctggctctggtggccccctccccgcctcctcccctgcaacctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatatccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgccctcgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctgtctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatcttccaaggcc

SEQ ID NO: 262500 - DNA, 4785 bp, Homo sapiens
atgcaattaatggccctggagcagaggtttgggtctgggttgccgggtgggggacagcctctgtgtctcatgatgtcttctccactccccccaccacccccccatttctcctgcctccctgccagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtacccaccggagcctccctacagcacacctacagtcccctcctcctcagggcgcctcaccccctcccctcggggagggcccttcaaccctggctctggtggccccctccccgcctcctcccctgcaacctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatatccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgccctcgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctgtctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatcttccaaggcc

SEQ ID NO: 262501 - DNA, 6689 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtacccaccggagcctccctacagcacacctacagtcccctcctcctcagggcgcctcaccccctcccctcggggagggcccttcaaccctggctctggtggccccctccccgcctcctcccctgcaacctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatatccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgccctcgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctgtctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagtatagaatagtggtgaagagctcagactttggtgccatataaccgggctctgccacttcctgtgtgtccttagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatcttccaaggcc

SEQ ID NO: 262502 - DNA, 1442 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggtctgcctagcagcggccaccccaggcccctcacatccccgatagccgcctcccccagggccaagctcagacactcctcttgactgcatctctgcaccctccacttcttcactatttccaccctttcatccagtcattcctccattcattcctccatccatccatccatccatccatccatccatccaacagatatttactgagctcctctgtatcaggcctggagctgggtgctggggacaaagtgttgagctcatggcctagcagagggcagacaacatagtttgctgctacagtccagagtgctcagagcaaagtcacagggaatccagatccctgcgggagc

SEQ ID NO: 262503 - DNA, 182 bp, Homo sapiens
gggccgagccgtggggcggggccaaggggttagcatcgtcccagctgcgccctccccagcgtccagtagccaaagtgcttcacaggacctcggctggagcgccaggaggcgctaccgggagaacagagccccacactgatggctggcgctcatttgccaccaggtcctggccttggggtgga

SEQ ID NO: 262504 - DNA, 609 bp, Homo sapiens
tcctttgcggactcctacctagatgagatggtgctccacatggttctgtccttggcttcccatgtgatcttgtctcctcttgaggcttcagataccactctaggtgatgactgccagtctgtgcttacagcccaaacctctcctgagcaccaacccatatgcccacggtgcagagacagcacaacccagtgtcaaggagcctggcttttaagagtcatgtaatcttgggcaagttatgtaatttctctgtgcctcagtttcctcagctgttaaaggaaggcataataatagggttgttgtgaggattaaataacaccatatatggccaggagcagtggcttgtgcctgtaatcccagtactttgggaggccgaggcgggcagatcacctgagcctcaggagttgaagagctgcctgggcaacatagcgagaccccacctctacaaaaaatacaaaaagtagctagatgtggtggtgcgcacctgtcccagctattcaggaggctgaggtaggaggatcacctgagcccaggaagtcgaagctgccgtgagctgtgattgtgccattgcatcactccagcctgggcgacagagagactttgtctcaaaag

SEQ ID NO: 262505 - DNA, 526 bp, Homo sapiens
  misc_feature (458)..(458): n is a, c, g, or t
gcccccactcttagccaccacgttatacagactcccaattcccaggccacacgaggcctctgcaaagtcgaagggtgcaaatatgactggagctgccacttactgagggtgacctgggtgccaggtactgagcgtggcaccttcagaggatgatctgtcaggtgaatgggaggaaagtctccctaaaacctatctgaggagaggagagaggtggctgacccctgccaagaaagcagagctcatggagccaccccccgaggagggtactggctggtgagagacatgggggtgggagaacagaatcttagaaactcactcttatcccatggaggctcccttctccctcaccttgctgagccaaagacaggcaggtgaagctcagcaaaaggaacacccgaggctcgggtctacctagagctaaaagaggccacacccagggcacaggtgggcaaacaacnagcccgcaggtcaaatgcagcggccacatgtttttataaataaagttttattggaacacagttacatg

SEQ ID NO: 262506 - DNA, 392 bp, Homo sapiens
tattttatttttattattttttttatttccttagattattggcatacaggtggtgtttggttacatgagtaagttctttagtggggatttgtgagattttggtgcacccatcacccaagcagtatacactgaaccctatttgtagtcttttatccctgagtcctcaaagtccattgtgtcattcttctgcctttgcatcctcatagcttagctgccacttataagtcagaacatacgatgtttggttttccattcctgagttacttcacttagaataatagtctccagtctcatccaggtcgctcaaatgccattaattcatgagaaaatctttttaaccttgtcttaggaaaagattttctagagacaataccccatgaacaatccataaa

SEQ ID NO: 262507 - DNA, 419 bp, Homo sapiens
gttagccggggagcaaagaaagggtccctgttgctggccatcggtctcctgggcctgagactgagggcctgtttgatcaggaggagggtagaaggaaggctgccctggtgacctggcagctgtgttcagacgccggaacctgggctggcactgtgggaacctgccacagaggtgctgtgggccctgaggagcaggagcaaggaaactgcaggaggccacagggaaccccaaagccagggctgccagtcactgtgtgactttagatgtccagaacactgagttgggctgacaagactgtcatgagggtgcagatatgacaagacctacacactcacctacatatatgctgccattctagtgccagatgttgtactagaggagaattaataaagaccgaggactcctatgcacatagggta

SEQ ID NO: 262508 - DNA, 310 bp, Homo sapiens
ttggtctccagggggctgcgaattcagggttttggggtgttttggttaaaacttggttccccagctgagatcctagggaactgtggtatcaaaaggaaaaggaagattagaaagggaaaatgaaatctcaggaaaggaaatgcaagattgcatgagaacatcatggtgttttgtgggataggtgatattctgccaaataaagaggcccgcccctccactccttttgcaaacctgagcttttcccctgcctgcagttgagcccagcatacctgtgccttggaaaaagcaagctatgccttccaagtgaaat

SEQ ID NO: 262509 - DNA, 451 bp, Homo sapiens
ctgatttctccctttgggaagggaggcttggaggctgcctggggctgagcagggagcaccatgcttgtaggcctttggggaggtttcgaggtccaagtgtgacttagaggaactgggagatgccagcagacactgagacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaa

SEQ ID NO: 262510 - DNA, 320 bp, Homo sapiens
caatctacttctagtacactggaagcagctaatgttcagtaagaaaagaatatttttagggccaggtgcatggctcatgcctgtaatcccagcactttgggaacatgaggcagatggagtgcttgagtccaggagttcaagacctgcctgggtaacatgacaaaaccctgtctctacaaaaaagaatacagaaattagccaggtgtggtggtgcactcccgtagtctcggctacttgggaggctcaggtgagagaatcacttgagcctgggaggtcgatgctgcagtgagccatgattgtgccactgcacttcagcttgg

SEQ ID NO: 262511 - DNA, 618 bp, Homo sapiens
catttctctgatgattagtgatgctgagcatcttttcatatacttctaggctatttgcatgttttctttggagaaatatctattcatatcccctcatccatttttaatgcagttagcgtttcttttatttatttatttttgctattgagttgtaggaattcgttactttggatatcaaaactttatcagatagaaatatggtttgcaaatagtttctccaattctataggttggtgtttcactctgttgattgtttcctttgctgtgcacaagctgttcagtttgatgtagtcccacatatctactcttgcttttatttcttgtgcttttgttatcatatccaaaaaattgtttccaagctcaatgtaataaaggttttccccttttttggtatgttttcttctagaagttttacagtttcaggccttaatttcaaatcttaacctactttctgttgatttttgtacagtgtaagatatacactatactcattcttttacttgtaaatatttagttttcccaacatttgttgaagagactgtcctttctctattgtgtattcttagaagccttgcaaaatattagttgatcataaatgtgtggatttatttctgggct

SEQ ID NO: 262512 - DNA, 628 bp, Homo sapiens
  misc_feature (580)..(580): n is a, c, g, or t
  misc_feature (628)..(628): n is a, c, g, or t
cttttgggaccatattcacgtatgtggtctgtcattgtatagataatgtattttataaagctttgatcataaatgtcataaagtgtttaagtatttataattacttatgtcatatatcatttatttctataaatatctctatataagtgtgtatatatatttgcttgcacatgtgtgtacattgacacacataggcatacatatataactgactcaataatttattatagcccaaagatttgattttgtactttttctttcagattctataaatacatgcaagtaattttatttaaaatactactgtttagagtatggaaaaaactgaattgattttagattcccaagagaatgctcatttttaatgagcattctaattgtattacattagagtttatctccagagacaataagggccaatttcagcgaggctttaggtattttacccaggaaatttgctaatgtatataatcaaaccaaataatgaggtataaatacagcgagcatacagttttgtttgaaatatattcaaatgcaatcttgctttgagatggccctgtgaagcataaatctccttccntttaaaacccatcatcataggtttcctgtggtgatgaccagacatcgn

SEQ ID NO: 262513 - DNA, 335 bp, Homo sapiens
gatatctttagccacctagtaattgcacagcttcttttatgcagaggaacgagaggtatgatggggggagggaccctaagtgttttttcagagtgggctttcttcctctcctctcatcggaaattaaaatgaagattgccattgtaacacacatttaagatgtagccgtgatgcctgccaatcagccggatcctctaaaaacaaaaaaaaaagaacctagatttttttttttagaagagaaaatagaatagtttatattgagtgttcttagaatcattgaggtttgttgggattgaactaacataatttataggtttagggagaaactgttcctg

SEQ ID NO: 262514 - DNA, 962 bp, Homo sapiens
tgcgcccggaggacgcggccttagccaatcccagggctacagggcgcttttaaaatgcaggaacctacttcagggaaccatacagaggccaaattcagaatccctacttgaaccgctgaccttttgccctctccaaggccggaagcaagcccttgcctgatgcacgcctcagtcgccccgtctgtaaagtgggcagcccatcaaattcacatctccctggctgagagtcatctggagaaataatgactatgtgacctaatgaaaattgcacggtgcctgccgagcgaggtgggtaagccactggcccaacgctgtcattacaggaggtgaagcagcgcgtgggctgatgactggcaaggggtgcagccgcaggaacctttcatcatgggttcccttgggaggccaggtaggtcagctctgaaagcacccggtgctgcggggcctgccttcctgtggcttcggcttgggcgccatcccaagccgggttggccagaactctgcctgtgcagccccgcccccaggcaagcaggaaacaatgcacctgagcaacctcctcccatctgcagaggaggaagctaaggtgtaggggggtcaaggcactggcctaaggtcccacagccaaggggtggctgggaggtgcaatcaggtctgcctggcacagagtctggtctcctgaccacgatgccaaactggttattattgtcaccacaatagaatactaataatagttgtcgtaattattattattgtggagggctgttctccaggcaggcaggtctgggttgctgcgtcactggggccaggaggctggctagtgcccacaatgaggcagggtcctgtcccaaacagcactaggagaatgctggagatgggaggctgagcccatcctgcagcctgggtcagcagcctggggcctcaccccaccctccatccaatgctgggtggcgggcagcctctccaat

SEQ ID NO: 262515 - DNA, 689 bp, Homo sapiens
tcaacatcctgtcctcggctggacatggtggctcacgcttgtaatcccagtactttggagagccaagtggggagaatcacttgagcccaggagtttgacatcagcctgagcaacatagtgagatccccatctctataagaaaaaatttaaacaaacaaacaaaaatcaacatcttgtccttgcatctcctctgggagatctcagcactacctctgcctgcaagccccccgtgtgggtttcaccccctcctctgcagggaaacagccttggaagttgggatgctacttcccctccatcttagtgtcatagggctgctgaaacaaagtccccaaaactgggtgacttaaaacaacaggaatttattgtctcagttctggaggccagaagtctgaattccaaggtgtcatcaaggccatactccctcttaaacccatagggcaccgtgccctgcctcttcctagctcctggtggtttgccaataatctttggcatttcttggtgtgtagatgcattgttcccatctctgccttcatcttcatgaggctggcttctgcctgtgtctcctcccatcctcttcccttcatgcatgtttgtccctgtgtcctgatttctcctttttgtttttgtgttttggagacggagttttgctcttgttgcccaggctggagtgtagcagtgcgatctcagct

SEQ ID NO: 262516 - DNA, 411 bp, Homo sapiens
gcattttctgctccttgaatccagcattgctccaactttttcccctatgttttctcttttctactgagtagacaagcttagtcgactaataaatctctcagtccttaaaactaggaggatctttttttaagttaagtttgcaagccatgcattcttttaagaattcatgactggaatttcaaagaattatctaagttaacagttttgtatagtctatgagcactgttagtatctcatggtttagaacaaagtatgatccatgaattcaggtatgaaagagagagagttttagtggtattctaaatttaaatataattgaatattagtgggatgtaagctttaaaagttctgtttttaagttttgggcttgttgtatactatggattataaaataaaaacgtttacttcatg

SEQ ID NO: 262517 - DNA, 471 bp, Homo sapiens
aacttggaaggctcctcatagttggtcactcatgctgggcctaggacatggtccttctgaccacatgaccccctgtggcacttgggaaccttgagctgtgagggtgaacacagccccagccttgtgggccccgcaccctcctgtgggagctgtaaccacataggtgatatgggatgtcagcggcaaaaggacctttaggggaaagagccagtgaggtgggatggggtgaaaggccacaggtgcagacaggctgggggctaagcaggggcacaggtgccaggcaccctggagtgcgcactgggagccacaggaggggaggttggagtgaagaggaggccagtcacaagggaccttgtgctgacagtgttctgcttccacttgaaatgagacaaaggactcaatgccaagtgactcaatgccaatgtcaatgactcaaggccaaataaaatgatcccacgtgcattttagcaa

SEQ ID NO: 262518 - DNA, 353 bp, Homo sapiens
gcaacgaaaaacaaacttatagagttccaagtacagatgctccttgacttgtgatggggctgtgtcccactaaatccatcagaagtggaagatatctgaagttgaaaatgcatttgatgctggtaacacagcagatggtccccgacttatggtggttcaacttataacttttttacttcatcctgatgcaaaagcagtaagtattcagtacaaactgtaatcccactgtaagtcataagaagctctttgataaacttaatgttaagtcaaaaaattgtatgtctaaccatcataagttggggactgtctgtattttgtaccttatgaggcttcagtaaaaggcactattttta

SEQ ID NO: 262519 - DNA, 537 bp, Homo sapiens
ctcactttgcctgttttaaaatccacatctatggaatcataccatgtttactctcttatccgtaatgtccttcctgcaacatggtgtttgcgacagtcaccagtgttgttgcgcgtagcactcgtcttattcattctcgttgcagcatgaattctgtggtgtggatgcccgttctggagctgttgggcctatgggttgttcccagttggtggctcctacaaaagacacagctatgaaccttctcaggcatttcttctcatgcatttagaagggaaacatatgttcagctttaggagattctgctttccaaaggtggtagtccaatttacactcccatcagcagcatctgagaatcccaattgcttatttgcctccttagaatttgggattgaggccgggcgcggtggctcaggcctgtaatcccagcacgttgggaggccaagatgggaggatcacgaggtcaggagttcaagaccagcctgaccaacatggtgaaaccatgtctctactaacaacacaaaaatcagccaggcatgg

SEQ ID NO: 262520 - DNA, 453 bp, Homo sapiens
aatcatcctagagagcagattcaaagttatcctaaattgtctgaggcagaaaacataccaagttactacagttctccatcatcacatcccaatacaaggtcttctgaacatggtcgagacattcccactcctgctgcgagaagtctatggccacatccctgaatgtcattgatgcccgaaatggcaaacccatagtgttactggagaaattaaaggaatactttcaagatggatggaggggaaataaggactgtattgcaggaagagagcaatgtaacaagcatgttgtctacaaatttacagtatgagggggactgaagtggaatgtatacgtatttttgaaaaagactgctggcatatagaaaactatgtggcatactctaaaatacttgcaccatttgggaataaataaaataataatgtttgcctatgaaagtaaacagtgaatataag

SEQ ID NO: 262521 - DNA, 646 bp, Homo sapiens
ggctgatggaagctgagaggcagtccatggaggccctgccagtgctgcccccagggaggccagggcccagctcctgtgcctggaggctccgagctttcctctcccaacagctctgcagggagggcagctctggggctcaggcaggtcagtaggatttctcccccaccccagcctgtcttgcttgcgctgctgtaacaaaataccttaggctggtgataggatttagatctgtgtccctaaccaaatcttttgtggaattgtaatccccagtgtttgaggtggggcctggtgggaggtgactggatcttggggatggatcatttttgaatggtttagcaccatcctcttgacactgttttcaagatagtgaatgggttctgcaacagcaggtcatttaacagggtgtagcacctcccccatctctctctcgctcctgccctggccacgtgagatgtctcactccctgtgcatcttctgccatgattggaagcttcctgaggcctccccagaagcctagcagataccagcatcgtgcttcccgtacagcctgcagaaccatgagccaattaaacctctgttctttataaattacccagtctcaggtatgtctttatagcaatgcaagaatggactaacacagctggat

SEQ ID NO: 262522 - DNA, 339 bp, Homo sapiens
gccccctgaagtttgagcattttgtgattcaacacaaacacgaagcagtaactgcggtgttgggcttgtggtgcagtttactgccttcagagagttttcaggatgtgacataggaaggaagaacccaggaggggactggtgggtttcctgagttgagaagacagactgctgaaatgtttccaggcagaccatggcagctagagttcagagggcagagcacaagagacgagattgctgcatagaaagagaactccagagatctgcagagggtcctgcttgaggattcaggcaattcatttctaatggcagcttatctactgaatagattttcaatactga

SEQ ID NO: 262523 - DNA, 483 bp, Homo sapiens
atccagctgtggaactacgccacagcccccagacgtgatccttgagccaaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaaaccaag

SEQ ID NO: 262524 - DNA, 536 bp, Homo sapiens
taaacttattatatgtattttttaagttacttaaactctttttgaaacaaaacgagagagggcagtcctaatgctgaggttgtccccactctcctgtcctccatattctgagaggaatgaatcagattggactttcacagttttcatttgtcaccacaggtgtataaggtgtctgtgtcctgggctaatgaattctgattgtgcaaattagcttcttaagcaatagtccctaaatacttggtgatttctaattgccttactaaataccatataattctctcaaaatgttcttttaggaacaccagggggcatatttttcaagacggaggtgctataaaatcaacaaatttgacaagctattcaaattctaaaatggcctggaatatttaactcaaaatattaaaagttcctgtaataacagctgggcacagtggcacatacttgtaatcccaacactttgggaggccaaggcaggaagattgcttgagtccgggagttcaagaccagcctgggcaatatagtgagaacctttctct

SEQ ID NO: 262525 - DNA, 2786 bp, Homo sapiens
ctcagttttctaatctgaaaaatgagaatattaaccatagacaactgccactcactgaacaccagctgcagtagagccgagcatacacgtaatcctcaccgcaaccataggagctggatcctgacatccccatctcacagaggaggagactgaggttaatgacgtggcaaatatccacaatgacagtttctgcaagtctttcctagtgcaatcacccacaaccacagccctagaaagaaggatgaacactcttccacagaggctggcacgcaccttaaggcaggtgcccactggaaccctgtctgtggtgtcaaggattttacagttgaccttgaagaccacctagtccaaagctctcattgtacaaaaagccaagcccagaggtcacataaagctttggacctgagcctctgggccccgcggtctggaaagtgctcctttctctgcatgctacggggctatcaacttgagctggtccagtctgcagatctacatcctgcccgcctgagcagaggcgggtgtgggaccagtgcggatctccacgatttgtcagcccatcctgataagtctgaggctctgaccatcatatctcatcacagcatcattaggattacaagtgccatgcggtagaagaggaagggaaacacgaacaaaaggatgagaaattaagcccatttcacccggaaaagatgactctgatttattgctctatagcagctgacgatggcctgtcagagaaattctgtgttgaaaataaagaataaaaatcacccagagttgttttgccacacatccaaattagaaaatgctactctccggatgatttatgcttcaattttttcccttattcacagagaatttgtccagcattacaagagcacctaagagcaataatacaattcaaaaggagatagaagaggccgcagaggtgttgatgtgcggctgagggcggggtgctggcccaaaggcagggctttggtgctcagaagcattgaccttacagggaggaacaaggagaaaccagccaggcaggccccgcaggcagcccacagagccacttcgccgtgcagccgagggagtcccgcaccacggggcctcgctcagggtagccaccatgggagaatgtccccacctcgtggatgtcaggcttggccacaggtccttggccacgggacctgagcagagtgacatatgccacactggatcagaagcacgctggaccaccacgtggtatggctccctttctttctcccgtcataagtacaagatgttggctgacctgactcctggggtagaaatgtcatgtagacactgggcgcggtggctcacgcctgtaatcccagcactttggaaggccgaggcaggtggattgcctgagctcaggagttcgagaccagcctggacaacatggtgaaacccgtctctactaatttacaaaaaaaattagccaggtgtgttggcacatgcctgtagtcccagctacgtgggaggctgaggcacgagaattgcctgaaccccagaggtggaggttgcagtgagccgagatggtacctctgcactgcagcctgggcaacagaatgagactgtgtcttcaaaaaaaaaaaagcactgtcatgcagggcagggtcccaaggccccagccaacctctcgttgacatgtaatgtaagaagatgtcaactcatgcttatagtcactgacatttaggaatagtctgttaccacggcataagctggtaaaaaaaaaaatcatacagctcttcttcccgggacgcccctgcacctctgctccggtgcacaaatgctttctcttcaaggcatggcgcaaaaaagccactacttccagaagcatctcctcattccccgccgggagcaacatctctcttctcgagaccccagcccctccgctgtctacccatggacttcctcagtgtttgttttttgcatgattctttgtgaccaagctgtttctccagctgccttgaggacatgccctagggaacagtgctctgaatcgtacctggattctgtgcctacctgctccatctaaagcagaaaactccacaactaagatctcttctaacatttaaggaatagagcctaattagcgcatgaatacgtgttgaactgtgaatgaatcaatgagtatggaaactacattatacgcagtgctgatagaaccaagttgccaagggagatatcatctctcctgcaggaaggaagtcctgcctcccactgatccactcagcgcacagccttgaacaaaacagagcaagagttataaccttcagatgtgggggcagaataggacccatttgggcagacacaggccacggaaaccacagggccagcgtcttgagccctcgatcagacgcctcccgcccaccgcggccgcttctccacgcttttgcccagatctctgcaccgcgtggcccggtcttgcctccctgaggaccacactggctgcaacccaaactcgactcttctacttacacttgctcagcatttttgtcatccctgcccttggccaatccctgtcttggtttctgctcttcccacacaaagttttgggaatcaattcatacatatttgagattaaccaaagtccatgatcagttctggaccgctatggattccagatccaccttacgtagccgtgtgagctccggtaaattacataacccatcaaatttctttatctataaagcagcaacaataatgtcacgaaggattaaggtaaagatgagaaatagtatagcaaaatgatcttccaaacctgttatcttttg

SEQ ID NO: 262526 - DNA, 398 bp, Homo sapiens
actaatattacaagggtctctgatccagtgagtggagtttgatagtaatttttgatacaagtgaaaataaataaataaaaataaaaaggtatacagaaaagataaaaatctcttgtaattttactactcactgtatttatttacaattatacataaatttatgttgcatacgtatgtattttattttttaaatgaatgtatgctaaaattccttttttcttttcttttttttgagatggagttttgctcttgttgcccaggctggagtgcaatgtcacaatctcagctcactgcaacctctacctcccagattcaagtggttctcctgcttcagcctcccgagtagctgggattacaggcatgcaccatcacacgcagctaattttatatttttagta

SEQ ID NO: 262527 - DNA, 341 bp, Homo sapiens
tactactactaaattcgcggccgcgtcgaccacagggaaaacagaacaaggacagggagaaacaaatgtttgaatagataatggccaagaattttaaaaaatgaattagatcaaaccacacaaccaaaaagaagctcagacaacccccaagcaaactaaataccatgatgatgataataataataataaaaagaaaatatgcctgtacacatcatagtcaaacttctggaaaccaaacatgaaaatatcttgaaggcaattggaaatttaaaaagaagaaagacacattacatacagaggaacaaagataagaattgcagcagactttttgccagaaaaaa

SEQ ID NO: 262528 - DNA, 398 bp, Homo sapiens
atggaacgtcattcattgaacagagcatctaagatgggacaatatcagaggctataacataagtaaattataagtaaatgggagtctcacagggaaaacagaacaaggacagggagaaacaaatgtttgaatagataatggccaagaattttaaaaaatgaattagatcaaaccacacaaccaaaaagaagctcagacaacccccaagcaaactaaataccatgatgatgataataataataataaaaagaaaatatgcctgtacacatcatagtcaaacttctggaaaccaaacatgaaaatatcttgaaggcaattggaaatttaaaaagaagaaagacacattacatacagaggaacaaagataagaattgcagcagactttttgccagaaaaaa

SEQ ID NO: 262529 - DNA, 394 bp, Homo sapiens
ccaggggctgggaatggggagaggagtgactacagagggacctagattcttcaacaaatacattacaagaggaaaagggaagggaagggaagcctggagattgaaagatacttgagacgtgtgaatccagtgcaatgtatgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccttggtttaaga

SEQ ID NO: 262530 - DNA, 1079 bp, Homo sapiens
cttgactcttgagtggacagtcaaggcaaagtttacttaggaaatgtaaagtatggagtgttttaaaaaattcaaattgagtttattcactgttggaggaattgaattctattgcctccctcatttccattatgttcattgttacaattgtgctgctctgttctcattgtgatgcttagttctcgtgtagaactgagtgctacattgtgattagaaactggagttgtgcttgagtcagtcctggaaaacaggacccatttttaagaagaacggaacataccactttggcattctggctgaccctaatttctgcagagttccttggtgttaaaatcatttgaggtcatagttgctgcttatggtttatatacacaccatctgctgctctaagttcacatcctctcaaaagcatgcaagtgcttgaaatttaaatatttcccagatctaaaacaacttgtgactacctaagaaatgcttgaaccaaataagaaacagcactgtggaataaaatataccattgtgaacatatctgatgctgcaatgaaatgtaaagttccttactttgctgatttttcatcataactccttgactcataaaagcggtgtctaaactgggaacagctgctaatagggtaaaagtattatacatcaaataaaagttcattacaatatttgtactcataagtcaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtggtgtctgtcatagcccaactagtcctggagcacatggacaattctgtaccccaataatcagaacaataaaatggtagttgtgattcaaaaagcgt

SEQ ID NO: 262531 - DNA, 452 bp, Homo sapiens
gcgtggcatgaagtggccactatggctgtggggacgcagacgtgtggcactgtgaggcgtgtgaggcgtatagaggcacgtgacgtgtgcagaggcgtgcagacgtgtggcactgtgaggcgtgtgaggcgtatagaggcacgtgacgtgtgcagaggcgtgcagacgtgtggcactgtgaggcgtgtgaggcgtatagaggcacgtgacgtgtgcagaggcgtgcagacgtgtggcactgtgaggcgtgtgaggcgtatagaggcacgtgacgtgtgcagaggcgtgcagacgtgtggcactgtgaggcgtgtgaggcgtatagaggcacgtgacgtgtgcagaggcgtgcagacgtgtggcactgtgaggcgtgtgaggcgtatagaggcacgtgacgtgtgcagaggcgtgcagacgtgtggcactgtgaggcgtgtgaggcgtataga

SEQ ID NO: 262532 - DNA, 824 bp, Homo sapiens
ctcaatcagctttatgcagagaagaagcttactgagctcactgctggtgctggtgtaggcaagtgctgctttggcaatctgggctgacctggcttgtctcctcagaactccttctccaaccctggagcaggcttccatgctgctgtgggcgtccttgctggcctttgctccagtctgtggacaatctggctcttgctctgttgcagattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaacagggagggcccccagtactgagcgggagccggcaaggcacaggtgggagcccaggagggggatgagcccacagtggatgaggtgggctgcagtgcttggctaagaggagagcaccacctgctcccactgtggggggacgtgctctcctggggggcccttcacagacactgaggacacgcgcaggcccagggtcagggctgagcttccctccagtgcagtaacgaggattccgtccaggctcccatgagcaggccagggctgagacagagggcgttggcaaggatgctgctcttcaggctgtgacccctctgtctttgcagggaggaagtgtggaggaacctcttggagaagccagctatgcttgccagaactcagccctttcagacgtcaccgacccgcccttactcacatgccttccaggtgcaataaagtggccccaagg

SEQ ID NO: 262533 - DNA, 433 bp, Homo sapiens
ggcagccctgggtttgacaaaacagtgcatcttcacgtttcgtgacagcgacttgcgctgtgcctcttcgggtcgaagcttagggtcagtcttgggatgtgcatctctggatgagggcagaggggcgctggctcagggttttggagtaatggctggactgtgcgtccctgaatgggatgagggatttgcttaagcagctagtctctggatatagaggatggcttgggctgttctcgctcagtttggtgggggcgattctggctcagcacccctaggttcttggatggggagttgtcttgggtctgaactctggattttggcagctctgactccattggggcatttatgacttcaaggcagaggttctggcttttggcaataaagaaacaactcagactgtaatactgtaataactccagagtttaatgtcacc

SEQ ID NO: 262534 - DNA, 468 bp, Homo sapiens
cagggatataagaacagaagaaagaaagaggacacttttctcctctccctcatgtacctcaggtatttactaggaaaaagaagaaactagggatgccttgctcccctcttcttagtaactaccctggacatttcatcattcacagacaaatgtcttgttttgatcctactcaaaagatgatttataatcagctataagattttgacaagtgttctcaaatgcaagattccattaactctggagattatgacattgaaaaaaatacagtactcatgaagaactgaaatgttcatgaatatcaagcagaacaagagaacagaatggattgaactaatagaaaacaagtattatttttaacctttttgcttaaaactttggtgatccttgctttgtttttttgagtcaaggatacttattttgacctatttaaaacctttaataattgagtaaactatacgcctgtgaaca

SEQ ID NO: 262535 - DNA, 389 bp, Homo sapiens
cctggtccctctctcccatagacacttggggacaggcctggaccctcatcccagcaggtgggaaggctacctgaggggttttaaggcgtaggagtccttctgtttgtttggttttgttcccctgtagccatttctgctgctgtgaagaaatgagcagggaggtggcaagtgtgtgggtgataatgacaactaatgtttttgagcagtgagtctgagtcaggccttatgcgatgcaaggtccatgcaccgtcttattcaaaccttccacacctgtaaggggttctctttaatcaacccattgtacaaatgagaaaaccaagacttgtgaagattttgcaggttgcccaaggtccccatagattaagagataaagcaagacttcaaatcca

SEQ ID NO: 262536 - DNA, 427 bp, Homo sapiens
gtttgctcaaaacataatgggaaatagaatattatggtgtgatgagtgcaaagtcagaggtatggtgcaggatataatgagaacactggaaacttccactcttttgcgagttcagggaagactactcggacaaggtaattagtgaactgagtttggaaatataaaaataatcaggcagaagtaaatagaatgctaagtattttatatttcaagagagagatcaacatgtttgaaagatattaatttgaaatcagtttcacttaagctccagattccacaagctccagattcaaggactaagacatgatgtatatgatttcccatagatttcctccagcttgttttttttttgtcatggattcaaatgagatgggcacatattaaatatgaaaaggtgtacttgaagccaacagagctcaagcacatg

SEQ ID NO: 262537 - DNA, 467 bp, Homo sapiens
tgcctggtggggagggcagcagacaggagcagactggcaatgacctctccatttagcctagaaggcgagtgtgccagcacctggccaggagccacggtcagctcctcgcacgcaacccagggcctcagaggctacgacacatgggatgttccctcccttctgtctgccagagcaatgacagctgactgtttaaaaattattatggtacaatatacataatgcaatttataatcttttaagtgcacagttcagtggcattaagtatattcacagggtcgtgcaaccaacagcaccctccacctgcagaaatcgtcacctggcaaaacggaaactctacccactatgcactaactcctctttccctctcctccgggccctggcaaccgccattctacctttcgtctctgtggtcttgactattctatgtactgcaaataaatagagtcacacagcgttaaaacttttgt

SEQ ID NO: 262538 - DNA, 593 bp, Homo sapiens
ggaggcaggggacgggggcttcctgaaggaggccccctaaggggaagggggctacaaggctggccagagtgctggccgcgcggctgtgcacagggccttgagcccctccggtcgtcaagccttgcttgaaatgcgtaaatgcggaaaggtgaagtggctgacccggctcacaccactttaagtagcggagtggggttcctagccaggcctatgggactcccactggagcctttccccctctggggctggggctggacccacaggctgccggagcaggcagaaggggaggggcccaaggcccagactccagggcctcgtctggatcatcaacccggctttgcccattcagcgcaggcctccgtttccaggcctgtctccccatccacaccgtctctcaggggtcgtgcaaccaacagcaccctccacctgcagaaatcgtcacctggcaaaacggaaactctacccactatgcactaactcctctttccctctcctccgggccctggcaaccgccattctacctttcgtctctgtggtcttgactattctatgtactgcaaataaatagagtcacacagcgttaaaacttttgt

SEQ ID NO: 262539 - DNA, 342 bp, Homo sapiens
ggaggcaggggacgggggcttcctgaaggaggccccctaaggggaagggggctacaaggctggccagagtgctggccgcgcggctgtgcacagggccttgagcccctccggtcgtcaagccttgcttgaaatgcgtaaatgcggaaagggtcgtgcaaccaacagcaccctccacctgcagaaatcgtcacctggcaaaacggaaactctacccactatgcactaactcctctttccctctcctccgggccctggcaaccgccattctacctttcgtctctgtggtcttgactattctatgtactgcaaataaatagagtcacacagcgttaaaacttttgt

SEQ ID NO: 262540 - DNA, 389 bp, Homo sapiens
aattaataaagcatagtctgttttaaagcctctccttcagtctggagacagaagacaaggccaaatgggtgtctctggaatgatagacttagaaagatctatctctacatgagcagcacattttaatgtattgagttcaagtctagtgtctttcaacttttaatgtgtacatgaatcgcttagggatttgtaaaaatgcagattcggattcagtaggcttaggtcgggcactgagctttggcactcataacaggttctcaggtgatgctgatactggtctacagccttcattctaagggtcaaagtgctagcagacaatgtcttaattggatagaacattagttaactttctgttgcaaatgtagattgcatcaccatttgacattgtg

SEQ ID NO: 262541 - DNA, 475 bp, Homo sapiens
cctttgggggtgattttgggttggcaagtcatgtgtgtgtgggggtctccttccttcagatccatgcatcagtgtgaatgacactcttctaatagatgacaaagaaccagacacctgccttttcacagctggatgtgcctcagaacatggcacacccaagactcagagaggcaagcaccttgcttaaggccacacagtgagacaaggacagagtcagaatctgagcctaggcctcctgccttccagcccagggctcttggggccccacagccttctgagaatatcctatgagaaagttggcttttctttttctttcatgtaggaaacagaaaaacagccaggaatcttgaatgtttatctaaatattctgttcacaaaaaaacattttaaccacatggacttgaatgggcttaaattcagtggcacggggtgtaaattccacataaataaaagcactttggattattgaaaaaaa

SEQ ID NO: 262542 - DNA, 618 bp, Homo sapiens
gtcacaaacaggagcctcagctgggcaccgtggggctatttgcagcctgacagcctctgctgaattattgatgcccctcagtacctcgggacctcctccatgttaacaaatcacactgcatattaaaatttaaagaggcaaatgagggcaatctctttccctattatttccctcttcttttgccatctgagctctaagttttaagtcaatcagcctgaaaggcttctcttaggagatggcacagctcagagagccaagcctaggaaaggaaaactagaggccatgagtgggcccaggactgagtcctgagtcaattaatggagtctgggggctctgggccaggtgagcactgactctctgagtcgtggaaacacctgagtctcaagtgtttccctaaagcagaagataaaaacttttaagttgtggtccaaatttgttgttgttgtttcttagtgaaaagagttgcaaaaattttaaaatcagaaggttttacctaaacctgtttttttttatatttgacgtgctattttgcatgcaaatatagtaaaaactgttttactacctagattaattattccttttattagtataaatgaccttttctctttgttttcatgc

SEQ ID NO: 262543 - DNA, 801 bp, Homo sapiens
aagatgtgggcaagactgttccgagggtcgaaactctggttcaggataagattagcaggtatttcacagagtcgacttaaggaagctagtgccggagagggaagaagtacgaagggcttgccagtgagccttaatgactgattgatcaagtgggagggcactgcactggcggtcagagaactgttctgtcactgacttgctcttgtgataatggtaggctagtgcatttctagctcaggcgcaaatttctcccgactctaaagtcatacacttgccttagatgatgcccagtggtcctctaattaatgattttttttaagcttaaagaccttcatactatacgttggcaagggtaaagtgtagagcctttgtttcacaagaagccagatagtaatttcttctccaggaaatcattccgtaagtcagaatttctcctctgtacccacccataaatgataatacaggccgtattttacctggtgctgtatttgtgtacctgtccgctgtcaaaatccagcccttgaaggcaggcttccttcagatcttcattgccttgcacaatgcaagggtaggtacttccatcttaattgaatttttacttcccataaaaattcttcatggtgacttacattagtcatcattacacatcaccgtcagttttgtaagcacagtgtcattcaaggtattgtaaaattttgagtttgatgatgtgtgacagtttcaattattttagtacagccctaatgagaacaaggccgtagtattgattcccttcaaagttggcgtctaagtgaaggtcac

SEQ ID NO: 262544 - DNA, 8160 bp, Homo sapiens
  misc_feature (5725)..(5725): n is a, c, g, or t
  misc_feature (8155)..(8160): n is a, c, g, or t
agtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaggaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagcngctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttcnnnnnn

SEQ ID NO: 262545 - DNA, 3491 bp, Homo sapiens
  misc_feature (2720)..(2720): n is a, c, g, or t
agctaatatattttgtttggtggaagaagaattgtaaacacgtggatagtatttgtattgggtaactgccggtaatgtcaggtgagccaatcataaatgttggaaaatatagactctgttacctttcaagacttcatattaaaacattgtccctctcttacttcatcttacagcaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaggaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagcngctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgat

SEQ ID NO: 262546 - DNA, 3738 bp, Homo sapiens
agacaaggagcttgagatcaacctgagcaacatagggagaccccatctctacaaataactgaaaaaaaaaaaaagctaggtgtggtggtacatacctgtggtcccatctactcaggaggctgagacaggaggattgcgtgagcctggctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctccgcagatacaggcccttcgctaggagtcatagttttagattccataaggaggagaaattgatgaagatctgtaagattaaaagtaaggaataaacatttaaaatatcagcatt

SEQ ID NO: 262547 - DNA, 606 bp, Homo sapiens
agggcaagggcatgtgcattgaggctgcatcataccagagttaggtaatcttccctgctgatgactgctcagtaaggtaagtcccacttttgctgtattgtgggggatcaatggcctctttttccctaacaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctcttccactgggaaaccttatgagtaacacctccgggggaaggaagctggctaggggtttttaaagaatttttggccaaaggggttggcactttggaactgggaacattggtggttaaggaggggaacatttttttgggaattaaacacaatgcaaaggcattgaagggcaaaaggtggtgtaaagagatcttgcaagaaccaggatgggtaatatatggagttgctctatttagctttgaagggaggtgggcacatttatttcagagacattgtacagtgataatcatggaatctgctatgttatttcccacttaggtaggg

SEQ ID NO: 262548 - DNA, 1177 bp, Homo sapiens
agtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtgtgagtatgacgagttgatgattcaactgacttaagaactgctaatttataaacactgtaatatttattttcac

SEQ ID NO: 262549 - DNA, 444 bp, Homo sapiens
agagaacatccattcattctaatggaatttccacgtagtgaaggtatgcagatatataatagggaacaaaagagtgtgttctctaagatgttaggaaataacaaaatgcacaatgagatcattagaggctcttgttgggtgctaatcatggagagaaacagaggcatggatatttggtaggacacaacattatatttggttttcattattgtctagaaataaaatattgttaccactataatctcccctccttttgttttattttaaaaataaaataataacgtgccagagagtgaccagctttgttcaaaacctttcccagcaccagagacactcctcaggaaatagaaatgagtctgcagaaagtacgctgcactcccagttcattagaactgcacagccatacaaattcaaggtaccatttacttgtttttcaacttgaaa

SEQ ID NO: 262550 - DNA, 475 bp, Homo sapiens
aaggtgcagctgtgagatgtagttatacacaggacggaatggtccttgactgaagctgcggctttccaatactgtattaaaaaaaatcccaaaacactgatggcactttggtgtttctgggtttgtctgttttgtcccctgcactcccctcttctttttttcccatgaagatgagtgaatctagggctacatgacttgactgtgtaacctggtggccattctgcaaaatgagttaggtggacaaaaattgaagccaatttacctgaatcattttcccactcttcagataatcatatttgttatcagtttcacttgttattgatgatggcgtgatcagaactttggtttatttgtcattgaattttttttctcactagtcgtttaacagaccttggttcggaattttggaaatgatctttggtgtttaagaagccaccatttaacaaaacattttcatttttttcatatattcttt

SEQ ID NO: 262551 - DNA, 315 bp, Homo sapiens
taagcagggcagagacttaggaaagagttgcagttgtgttcaaaagcagtcagctggctgaatttatcctcacttggaaaagctcctgttattccagttgaggagagaccatatcacattctagagatggctgcatgcaagcatttgaaacctttgagagaatacagtgcactctggagactattattatgactattgggagaataatatcaagagtttggaatatgcaccttcctcaagatccccataaaacaaacctcctaaaatcaaatggatcaaataatgagctagataaagaatgtactcacttggaaa

SEQ ID NO: 262552 - DNA, 575 bp, Homo sapiens
tggagggcatctttaagtaatattagtgatctcaggcttataagtagctcaaaataattagcaaattactgagaaatgagtggtttcttatagcatgttttgaattatcgtaggttatacaatctgttttacaattggagagtagtatggactgttttgcaatgtaaatgtgatatacgtgcactggtcagtctgaatgatttcctttaatgatgtatttagaggaatcgtggtgctggacacactgctgtcttagggggactggtagaaagccaatactataatgtcaaggtgacgctgggcagtctgttcacattagccaggtaccctcaagagataccaaccaagaagttcccatacctataagatgaaggctttacggcgaaatgaatagatttcccaaagttaagctccatattgttatcagtgaatttgtaatgattctttcagcctaagttgttgaaggaaagaaggaaaggagggaggaaggaagaaaagaaggcagacacttgtatatatttctaaaggcacctttgctttcatagcaggattattagctatttgagaaaaaaaaa

SEQ ID NO: 262553 - DNA, 366 bp, Homo sapiens
ggtttcaccatgttggccaggctggtctcgaactcctaacctcaggtgatctacccacttcagtctcccaaagcgctgggattacaggtgtgagccaccgtacctggcccatgtacttcttacttagtttttcttcccgcgtcttatgtttacatttgcaattatgtcttcttctttcaacaaatattacaggttttcataatctcaaatatttgtttttagagcatgatgtaatgttcctttgcattaggtacactgattgtgggtttccaacaaaaagttttcaggtctaaaaatgatcacatcatgcagtatacccaggaatcaaacctgcacatctatcccctaagtctaaaaatgaaagtt

SEQ ID NO: 262554 - DNA, 687 bp, Homo sapiens
aatttaccaccctcgttcaagaactgaaagaagagacatcctccagactctccaggcaacaagaggagctggtagagatgctaacaacgctggaggccctgggagaggccatgagagccaccccgtcacaaggagcttttccacacctgccatgcagctgagagccaagccctgctgctctctcccccacgagggggctgggtcttagagcagcactgttcttttcccctccacccaggcctcccgagctgccaggctctgtgctcccacactgactccatctgaggggtccttgaggccagtggatctggagtaccccgcccctggcctggagttcctcctccttctcacgctgacactgcagccagctcctcaatgggcggtgcctccaaatctaaagaatatggaggtcctggagcacaccaagaaatgagggactttttctttgcagaaagtttgaattctgtcttaatgagacagaatgccatacttgagcacctcatcttttgctcaaattgaaatgtcatcgaactgtatttctcaagtcaatggtctgtaaatatgatttatgtattaatctcctaagtgaacaatttatattttatcctctacataattatcgtattatgctttaaatatatatttagtttatcaataaagacattcagtactcaatagcaacttttt

SEQ ID NO: 262555 - DNA, 338 bp, Homo sapiens
aatctaccttaaaacaattaaaaatgttagctccaaactggataatgacagactgcgttgttctttaaacttttggaaatgtgtgttttctttgaatagtatgctataatgtgattggacaacatatgattcctaagtttatttgaataatattggtgtttattatgcatctttcaaaaaaaaagttaaaaagttcaaattaagaagtattatagtcaatctcttccaaggaagtattccaagtaatagtggagctggcccacagattgactaactgctatatgaaattgagacctatgctttagggctttctatggctcgtaatcatatatttataa

SEQ ID NO: 262556 - DNA, 465 bp, Homo sapiens
caaatatttaaatctgttacaaaacagccagtagaatgggaggttgtgtgtgtgttcaaagtatcccctcaaaatgcagatgattggaacaaaagcatgaagggaaaaaacggggacagctgagctgcaactgattacgcagttttcttttatgctttctgaattccaaggtgaaaacgatgactgtgagtctaacctgttacagaggctaaaagtggcttcaaaagcaatgtctaaaagagaacaaatacatgatacaagcattatgtagtcaacatggcactgaaattctttgggctcccggagagtttaggagaaaaccttaactgatttttcttcattctaattattgtcctaacacttagcataatatttgagaaaggaaataatagacaactcctgctcattctccatcaccacaatgagtacttttccttccccttaaataaaatggctccatcaaaa

SEQ ID NO: 262557 - DNA, 500 bp, Homo sapiens
ctaatgtgacaaaaaaacacatggtataataatcattgcattcgtgaattataaagcagcatttcagataagtcctagacactggagaaaacctgaaagactggccaagaagagaaagacatccactcatggcaagaaaggcacctctcttggcacctgccattgctctctgaggtttggtcacactactcatttttataccagcagtgtcctatcagattgtcttcaagcataaagccaagctttgcacaaaagcagaaggtctgtaacaacacatggcccctcacaagaggctatgcacagatggaataagagctagaaacatggtctgcagcagggagaggaataacaattaccatcaaaagtcctctcaggccaaacgcgtggctcatgccggtaatcccaacactttgggaggccaaggcaggcggagggcctgagctcaggagtttgagaccagcctgggcagcatggtgaaaccccgtctgtactaaaatata

SEQ ID NO: 262558 - DNA, 447 bp, Homo sapiens
tccttaaataatgatgctttatataattctaagaaaactcaaaaattttctgaaatcctgccccccaagttcaagatagttttaaatgaggttcttcttcccacattgaggaaattcccacaatcatctaataaattcactctgatatatccattgtgtgatacactcctctgttgttccaacctttatttcacttgatatgaacacagttatccccaaatatacactgtactcccttgcttgccctctgtggcaggttttcagaattttcctccaattgctcctcaaagagcctccagcttcacccatcagagcatacacacccagtttctcctgtgcaggggctggtggagtcagatggctctacttgtctaggaccacatatactatgttcatatttgaatggaaaagggagaaaaagctaaaatacattaaagtgaatggcaa

SEQ ID NO: 262559 - DNA, 358 bp, Homo sapiens
cctccaaccctgtgaatggccattccattcacaggcccattgtgcagagactgcctgacctgccctagctgaatcatcccatttgctctgtgctctgctgcggatgctgtctgccgggcaggcatttgtgtaagacacatagatgggccaaatactgtttgtgtgaggagcatgtgtgagttcttgagctgagaggctgtgatatccacagcatggttatgcagctgcttcctggccaccctcctctccatccagctcttatgtttctccagcaggtctcctacctttgggaatttctgcaccaaaagcaggcacatactcttggtcacatatagtcctgagggcagcccaactccgc

SEQ ID NO: 262560 - DNA, 474 bp, Homo sapiens
gacttcagccattgtcagcgacatgattgtggtggccaagtggaacagccccagggtagatgatgttgtgaagtcgatgtaccctccgttggaccccaagctcctggacacagggacgactaccctgctcctgtctgtcagtcgcctggtgctggtgacaaggaatgcctgccatctgacggggggcctggagtggattgaccagtcactatcagctgctgaggagcatttggaagtccttcgagaagtagccctagcttttgagccagataaaggcctcccaggccctgaaggcttcctgcaggagcagtctgcaatttagcgcctacagaccagcagctagtcctgaagacccctgccgccatcactgggtggctcagattagccttccactttttcctgtagaattagttgttctccacggctcaagagttcagctgtgtgtgcatagtaaagcaggagatctctgtcagt

SEQ ID NO: 262561 - DNA, 702 bp, Homo sapiens
aacataggagattgtactgatttgcactctcactagccatatatgagcatgtcaatttctcctacatctcaccaacacagtatattagcaagattctgatatttactaatctggtaggtaagaaatgtttgtctttttaataatttgatgacccagctggttttcctcagttcctctcgttcctgctttcctcttctcttccatgttccactcccatctctttctgtctatcatcaggtatttttggttgagattttcacgtgcttaaagccattgattgggaagcatccacggaacagatgatctggaagaacccagagttcagatatttgcaggaaactgaattcaacgaggatgatgaaaaaaagcaatgaatcactcttaagaactagacagcagcaaattatcgattcaatacacagttgacctacaattccacagtttctgagatgaggtattataaggtgagacctcagggttactgaagtattgataaggccttctggtcaacttgtcttgtcatagccaaagaatacatgtttggccttaaatggcctaaaattaaaaatatatatatagatatttagcagcatgtccagcacacataactgcaatctagaagagttgcagatacacaaatcaaactcagccagtgggttagcaaggaagctgaaggtgccttgtcctgtgataagcttcctc

SEQ ID NO: 262562 - DNA, 694 bp, Homo sapiens
aaaaaagtttaagaaaacaacagtggtatatgaatttaaaaagaaaaattaagacagtgagatgtagataaagagacagggtagagttctcacttcctggtctaatcaggcattctaaagaatgtacgtaaaaggaaccagagttaagaactctgtcctatatcatgaattaacttgcatgtttcaaagaatttgggactatagaacatattttgggattaatatagtctgaacttagtgtagtagttacttctggtttaaaatagtatctcaatttccttttcaccttaaatagacttaaggaacaaatatatgtgtagtttgcttgacgttttacataaaagaaatttaatatatgaattaaattataattgtgtatttttaggatatatcacattaattaaaacagtgaataatgtggtacatacatataatggaatatatttgacctcaaaaaggaagaaaaattttgacacatgctacaatatagatgaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaaaaaaa

SEQ ID NO: 262563 - DNA, 386 bp, Homo sapiens
gcttgccacccttaccctgcttgactcccaataatgctcatcccccgggaacctactcattatgtttattacgcatggtcagtcttctccagctgaagtggaaactccacaaggcaggaatcttcatcccttttgttactctcccctatcccatgtgcatgccagaaacagggcctggcacattgtaggctctcagagcttgttgactgaatcattaaatccatgctcccccactccctctgcttttgatatagaaacaaaggtcactgaaattgctcatggaaacttgggagttgcagttaaaatagatccctcttacctcgtgcatacatctaatttcattcttccattattttggggtttatatataagcctggttcttgctg

SEQ ID NO: 262564 - DNA, 363 bp, Homo sapiens
ccacttcacacccttctggtgccatgtataatggcatcgtattaccatggccttttgattatcttgaacacctctttggtgctgtcatttgctgagattcagtcatagtggacaggatatgtgtttttattttttttaaagatgactaacacactgtgcatataattctaattacctacccttgacattttatgcgcttagtgcaataaattattttgctagtttggtctaagaattgacgacctgactttagatgtatttatttcgcagcgtggctcatgggtgatgtgataacaagctatgaaacattggaaagcaagcattttattctttaacaccaagttccaaatgggaaaagtacag

SEQ ID NO: 262565 - DNA, 486 bp, Homo sapiens
catcccaaatcaaatgttttttgttcaaatatgaaagagcaataccaaaagttatgttttattttgaagttttaagctaagcttcataaattcaagtaacctataatttttcacaattcaaattttgaataaggacaggagctggctacagaggaaagcaaagtatattattttttcacctacttttgagaattttaagaatcaccagttcagctatacatttttgttaataatatttctcttgcattaagtagcaaactacatcttatagtagcaaatgtagacattcaaggagaaatcaacaaacccatttctctagtaaaaattatatttaccaggaaggtatagactgttcaacaaataggccaggcacagtggctcatgcctgtaatcccagcactttgagaggccaaggcgggcggatcacctgaggtcaggagttcgagactagcctggccaacatggtgaaaccccgtctgtctcaaa

SEQ ID NO: 262566 - DNA, 383 bp, Homo sapiens
tacatgctttgtgtgcattttaaaaaattaatgttctctttattgtattgaaataatgattatatcttaatgcggtcatgttgtgttgatagatttgacctctctgtaggagatgagaattgacagtgaccatcatttggggaagggtgcctttggtggcaagtttgtgctggttcctctgaggctgtctttgagggtactttaggtgttggaagttaaagactgccgctgccctttgtagttacatatataatgttaatgttggctggggtggtgggtcacgcctgtaaaaccagcactttgggaggcctaggtgggaagatcacttgaggccaggagttccaagtccagcctgagcgacatagcaaaaccccatctctaca

SEQ ID NO: 262567 - DNA, 435 bp, Homo sapiens
aaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatg

SEQ ID NO: 262568 - DNA, 388 bp, Homo sapiens
gttggacctcatgaagccccatggaccctgttgccccattaacaggggctaaagttcaaaaattagaatgatgagttaagctccatactcttaatttcttcctttaaaaaaaaatcaattttggctgggcgcagtggctcacgcctgtaatcccagcactttgggaggccgaggtgggcggatcatgaggtcaggagatcgagaccgcggtgaaaccccgtctctactaaaaatacaaaaagttagccgggcgtagtggcgggcgcctgtggtcccagctactcgggaggctgaggcaggagaatggcgtggacccgggaggcagagcttgcagtgagccgagatggcgccactgcactccagcctgggtgacagagcgagactcgtc

SEQ ID NO: 262569 - DNA, 617 bp, Homo sapiens
ccatgttggccaggctgtgtttgaactcctgacttcaggtgatccacctgcctgggcctcccaaagtgttgggattacaggcatgagccactgctcccggcctactgtcacttcttaacatattaatctttgtatttctgaccacctcaatatccacagtactcagtccccatgctactctcaccatgtaaggaaagacacttgcttatctgtaggacggctttctcagaacacagcctaaaccgatgtctgctctgtacgatggtggacataccgctgtctaggaaggattaccaagtgacatggtcagcaacacaaccccgttcttgtagctcccttgaaatgattcctttctatgcatctatttgccatgtcgtgtcgtgttgtgcaggtttgtcgtgtgggtatatgtgtgccgtggtggtttgctgcacccatcaacccatcatctaggttttaagccctgcatgcattaggtatctttcccaatgttctccctccccttgccccctaccccctgataggccctgctctatgttgcttccctccctgtgaccatgtgttctaatcgttcaactcccacttatgagtgagaacatgcggtgtttggttttctg

SEQ ID NO: 262570 - DNA, 473 bp, Homo sapiens
ccatctttgtaagatccctgaaagaccacgagattgggattataggaggggtctgaaatctgctaagatgtaggcttagttaaataataacctgccattgttccatagcttgctttcttataatccctaatcattcaggattcatgaatccagacttcacaagatttgtgacttccccaattgctcatatagatacccaaagggggccttttgagatgtttttcagactattgcattcttacaactaactccatttggacccatgactcagtactcaacccagtcctgtggtccccacccaaaggctgactcagctcacgaggacagttttccacacccctatgattttatcttcaaccaataagcactacccattgcttagcccctcccggccaaattatccatgaaaaccctagcttccaagctttcaggaagactgatatgagtaataaactcctatctcttgcttaaaa

SEQ ID NO: 262571 - DNA, 385 bp, Homo sapiens
tccatagcaacttctattctgttcaattaactgcctaatgtgaatatatgaataagtttctgtgtttaaggagaaacccccaaacaacagggtgatttaagagtttgcagttacagatgtaagcatgtcaagtttaccttattttctactttatttttggaaatacatttttgatgtttttaggttctggacataactattggtgaagctgaataaattttaatgaatttctaaatggcctactgaaccagattctcccagtccctcagctactccctggttgtaaattatgcaaatgtacaagctgccttaactctttcaggacaccagggtaccatttggcaagtagctactccagggaacaaatccatcatggaaaaagaaa

SEQ ID NO: 262572 - DNA, 281 bp, Homo sapiens
cacatggaagcgtgagaggaagcaagagagaggggggaggaggtgctaggttcttttaaacaaccagttctcttgtgaactcagagaaaactcactcattactgtgaattcatcgcgcccccatttttaagtgaagctgtgaagctcctttctactactcatcatgcgataaataactatatccggtattagctattgtttccaatagttatcccagtcttaaaggtaggttaggtaccgtgttactcacccattcgctactgaatgtattgctacatccc

SEQ ID NO: 262573 - DNA, 538 bp, Homo sapiens
ctgaaggacacaaccttccccaaagtcctgacgtcgctgtttgctggcaacaaatagagtcaaaagaagagaggcacagaatgtgccaggggtgtgctgcgtacagccccgatgaccacaaggccttcttgggtcaagttctgccatctctggttaagatgggctcaccctctaggaccctgattgagtcctcggaccaccaagagtgccccaccaagagcctccctcttctggtgactcgtgcctgcttcccgtggagagctccagaagggaggaaactgtgaggaggtggagaacgtggcagggatcctaactttcttactgaaggaagttcttcacaagtacccatctgccttcagggaagaaaacataactcattttggtctttcaaattcagttctcaaaaccaaatcctgttgtcagcaatctgtgtcccaacgccttcttcagcaacagcattttccctgtggaattagtttccaatgttctttcttaaataaaccactgaagattaaaaggaatccagatacccaccaca

SEQ ID NO: 262574 - DNA, 562 bp, Homo sapiens
atagtttggcctaaataatggaaagccagccaattcatattcttgaggtattattatttaattgtcaacctgacaattattaccaaaaaagatagaaaattatagaccaacattacgttggtctgtaaaagctgtaaaagcaaatatactagcaacccacactgaaaaaagaaaataatctgccaatcaagtagagtttattctaggattgcaaaagggagttaaaattaagtaatctatcaatataataaattacttcattatagcaaattggaagaaaattgtatggttgcttagtagaagataaaaattcattcattatcatttaaaacacattttcagtaaaatgttttaaaactcatattgatataactcaataaaaaatatcaatctgaaatctgcagccacttatggagaaacaatatagacagtcttatcaaatttggcaaaagaaaaatatgctcacattgtttagtactattctctaagctttagctcttgtaagaaattatgagattagagatattgggattgaaaatcatcatcatttgtagactacaag

SEQ ID NO: 262575 - DNA, 550 bp, Homo sapiens
aagtcaataagtcttagagtctcacgcaaggcctatagtatacttcctgggtatcactactggttattcagggcccaagggctctttagtcagcacatggtaagtcctggcaggactgggtttttcacttcaaggcaatggatttccttctggcccagggtgtgtctagaaatgtcattcaggatctagggcctggaaatgagaactcacaactctgattggtgtcctattttactgtgactgagctggtatccgtgatgcaagacagagatgtctttactctcccctctcctctcttcaagtggaaggaagggatttattttggaactgcaagctgtgcagcttggggttgggggacaagtggtacaagcatttccttagcttccccagctggagtctcagtagctcacatatccccctgagtctactggctcttagccaagtttagcactaggacttgccttgaatttgcagtccttgtggcccagactgcttttctatttttttgacggcaatattagatttattaaagttccatatttaaaaacgc

SEQ ID NO: 262576 - DNA, 897 bp, Homo sapiens
ttgagtttctactccattcttactggacttttttcaatcctttaattttttagtttttgttccagtcaaagtttttagttgcatgaaacagaaactaactctgcctgatttaagtaggaaaagaatttgctgagaggctattgagtagctcacaaaatcatggagcagcaggctcagaaacagtatttttgagcagtggctccgaaggcaccgtcttcttcaagaagtttatccggaagccaatgcacccattggacataaccgggaatcctacatggttccttttataccactgtacagaaacggtgatttctttatttcatccaaagatctgggctatgactatagctatctacaagattcagacccagactcttttcaagactacattaagtcctatttggaacaagcaagtcggatctggtcatggctccttggggcggccatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctgatatttttctgtaaagaccatttgcaaaattgtaacctaatacaaagtatagccttcttccaactcaggtagaacgcacctgtctttgtcttgctgttttcactcagcccttttaacattttcccctaagcccatatgtctaaggaaaggacgctatttggtaatgaggaactgttacttgtatgtgaattaaagtgctcttcttattttaaaaaattaaaaa

SEQ ID NO: 262577 - DNA, 420 bp, Homo sapiens
aagtcccaataaaattttatctgtttaagagacataataaatgtctctactgtgagctactgtctaaagatctacctaacgtaagccaaaataaacaaaagctgggaggagtatgagggagtattgccaaagacaggtacacattaccaaaaaaaaatttaaaaagcaacaacaaaaaaggtctttctaataactagccaaccaccacttcagtgaaaccaagagactgataattactaatactttcaagtttcttctgccttacttggtcatttattatatttgcagttataactgcttaacaccctgaaggattgtgtacttgtttctgaaacagaaggatatgctgaggttttgtaatctgcttcacattgggtatgaaaggaaaaggaacctaggtgaaaaagagacaggagcaaa

SEQ ID NO: 262578 - DNA, 775 bp, Homo sapiens
agccaagaagagaaatatgcaagataattaagaagaaatagactatacttacagaggcaaacaaacacacgattttattggtggtagatatggctgattcatattttgattaaacatcacattgacttaacatgtacatagagttgcagatttacatccaaaatcataatacgtaggtaaaaccaaactcacaaaacacgaatgtcaaggaacttaccaaaaaagaaaaaaaaaatagtaatatgaaatttcaagaaagaatgagagaaacaacgaaaaaactcctatataaaacatagatttacaactaagaaagaatcctcctagataactacaatcttcagctgtgactgtgcatccgtggtgagcagggattttgaatcaagactgcgttaggaagaggctcaagggggcagacagtgccacctccagagaagccactgctcctactcctgcctctcctgctactgccgccacggtcctctgctcctgcagcccccactgggcgccggattccttcttggagtgcggaggtcctgttccttcaggaacgacagacagcttttctccccgtctcctcgtttgctcagccggcaggtgcaggactggagatctgaggtggtcctgcgtctcgaggagccgggcgcccgactgtgagaaggaggaggcaagctatggggagagggggcgacaggaatgccaggctcatgaggccggcggccgcggcccaggcagggctggctgctgcctgggccggatggtaagagatactgtg

SEQ ID NO: 262579 - DNA, 514 bp, Homo sapiens
gcggccgctttggccgagtctgcccaggctttgactcagcagcagcctcccgttcgtgggaaaccggttgaaggctaggaggaccgggcagcaggcctggctgcctttcctccgccccacccggagtggtgaacattccagtccctgccgcctcctggtggagtgtcaggccacctacaaattttgtgggacccctggccgtgtcttcagatacaaattgggtggttggccacacgtgtgcccagggcagattcggaggcaccttttaatccgtcctctctctcctgcaggggccctggctgggagcgaaggcaccgcttactctcccaagatggaagactgggccggcgtgaaccgcacggccttccccgccacccccgcagtgaatgggctagagaaacctgccttagaggcagacattaaatacactcaggtaaccaggaggcacgtgaggccgtgaccttaagtagggaagcagaaggtttgggcaagtggggaaaaagagagagaaaga

SEQ ID NO: 262580 - DNA, 979 bp, Homo sapiens
gcggccgctttggccgagtctgcccaggctttgactcagcagcagcctcccgttcgtgggaaaccggttgaaggctaggaggaccgggcagcaggcctggctgcctttcctccgccccacccggagtggtgaacattccagtccctgccgcctcctggtggagtgtcaggccacctacaaattttgtgggacccctggccgtgtcttcagatacaaattgggtggttggccacacgtgtgcccagggcagattcggaggcaccttttaatccgtcctctctctcctgcaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttag

SEQ ID NO: 262581 - DNA, 1506 bp, Homo sapiens
tctgcgcccttgcccactccaagccagacccaggcggtttgcccttggactccgagctgtctggggacccacaggtcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttag

SEQ ID NO: 262582 - DNA, 495 bp, Homo sapiens
acacacacttcactccctggcttgccttgtatgggggtgagtatggaaccccgcagggactctgggctctccccacagagtcccatctagacctaaatgcagtcccaggtcccacaccccaacccccctccccccaccactgccacttccaaacccgccccgcagtctactgtgggaaggaggtggggtaggagggttctgagtgcctcccacacccagggcatgagctcagcagcctcagggttctggtgcttcctaggcctgactttacaatctctgcaggatctctcagtgagcatagctaccccaagcccctgagaatcgtgaatcccagagacagatgcctggagctgcttccagccctggggcaggcctcaaggggctacccactaggacccgtggccctccagggatgggaatgattgttttaatcacttttattttctaaatattaaagacattcttccttagtgaaggatatttggaaagcattga

SEQ ID NO: 262583 - DNA, 618 bp, Homo sapiens
gtcacacctctcagtagcttccctcatccacaaagctggtaatacaagcacgtggaagtgcattcatcgtacggttggagctcctgatctgtgaaaggactggaaatgtaaaatgcgctcttcaagtacaaaggcagagaggatccataaacaggcacaggctgccctttggtataaactgttcacattaaatcttgttatctatttattacatactaattcaagattttttctcagggtggcatgcatattcagtagtgtttgtgtattgtactaaaccctgttcttactgaactgagattttgcattttttataagcagagcttggaagctgaacccttaagtgtctaccctggtcttgtggcatttcatgttgagagcaccaaaatattccctgtgtcatgggaagggtagattatgagagaaagagcagataaactcctgggccctagggtggttttttttttttgtttgtttgtttttatatcatgtatccacaatgatcatttggaaggaatccaagtgaatcaagtgtgagtcaaacagcattgtttatagatgctgttgtagtctgttctatgctgccgtagtggaataccacagactgggtaatttaca

SEQ ID NO: 262584 - DNA, 530 bp, Homo sapiens
aataaacagtccctttattaaaggctccttaaattaccaaagtcaggtttgccatctgttccctgccacgactctaaatgataaaactgcttttgaaattttaagttgctgtctaaatgcaaggtatttctcgtttatctctgtgtagcactttacacaaagcagattgctgctattaataataaatggtgaaatgaatatatgcaagaatgaatgagtgaatgatcctgcccccttccactttagttacagtcttatgctggggatatatccttgtcaccttgattagattttgtaatgccctgatttgatttgggaggtccccttttcccttggaactcaccgtctcttagagtatctgcagaaatgtcagcccttgtatatttctagtggtttaacttgaaagggccaactttgtttccaatttctagaattatcccccttctctaggctgcacatttacttgataccaaaaataggttacttatttgtttattcatattttttcttcttcaacataaaaactggca

SEQ ID NO: 262585 - DNA, 214 bp, Homo sapiens
ggtacacatactattccttttactgcccgatagataaaagactggattaggacccagagagacctcccttattgaaaagatagtcaaagaatttgaccttattgccatcttttaatagtatataaccgatattgtgtgttctttcatttctatctgtgcctctctgtagggattagagatggggaattagctttatcaagcctttgggtaaaat

SEQ ID NO: 262586 - DNA, 364 bp, Homo sapiens
aaagaggtaagtctattgaaatagagatttaatttgcctcttttattgttaatttcaggacattcaacttggaaaatgtccatttctaaagcattacgtatagaaaaacactatttgggccaggcatagtggcttacacctgtaatcccagcactttgggaggccgaggcaggtggatcatttgaggtcaggagttccagaccagcccggccaacatggtgaaaccccgtctctactaaaaatacaaaaattagccgggtgtgctggtgggcaccagctactcaggaggctgaggcaggagaatcacttgagccctgtaggtggaggttgcagtgagcagagatggcgccattgcactccagcc

SEQ ID NO: 262587 - DNA, 1181 bp, Homo sapiens
tgcacttcaccaagttccccacctgattctggatgtccaagaaccactggtacctgggctgattagggaaggcctcatggtggggcgctgccagatagagactctgaaaaatgaccaggactgtggccaggaaagacattccagccagaagcatggagtgagggtgggaagcacctactgtatggcaggcaccgttccgcacacacatttgttaatgcacacagttccatgtcagtcctatgatgtaggtgctattcttatcctccctgctttccagataaggaaacaggcactgaaggggcaactgacttacctactgtcacagtggtaagtagcacagcccagattccaacccaggcagtcctggtgtacatgttggcatatactgagaagtcgtagcaaatgaggttgaaaagataagagtggggctgaaccatgcaaagccttgaatgctaatacaaggtaaatttggacctcacaacaagcagaggtgggccattggcgggttttgagtgagacagtaacttgattcacccccaaactaaggagtccttatctatgtgatcagtgccatccatgtcctgtgctgtagggtacatggccggcttcccgagcagggttggtggcagctggcagtggttggtgaatgtccaggaagtcttaactcaagccaccccaaggctgtgattcagaacattttcgtggtccgtctcatctccacctcacgggacagagctggaaggctgtttggtttggccagcgaccgaaagcagagggagccaagagtcacagagtgaagggcaatgtgtgccttcaacagggccctccctctccgccccactctgccttgccccacccctgtccctgggaagggcatcttttagagttaacttttctcattgccatccaaaaatagcttgcttgtttaactagtttgttgtttaaaaaataaacataaaagcaataatacagtcataattttaaaattcaagtactaacaggaaaattaagtaacagactaacggtcccacttctgacttcttagtccactccccagagataaccaatatgaagtttttggtgtatccttccaaaatttttctgtgtatgtgtcacatgtatgtatatatatatgcatccttttagtccttttttacataaatggcatcataccgactaat

SEQ ID NO: 262588 - DNA, 365 bp, Homo sapiens
tattaaaacagccaataaacatatgaaaaaaaatccttaacatcactcatcagggaaacgcaaatcaaaagaaagagatacaggtctggtgaggtggctcatgcctgtaatcccagcgctttgggaggcaaggtgggtgaatcacttgaggtcaggagtttgagaccagcctggccaacataccgaaaccctgtctctactagaaatacaaaaattagctaggtgtggtggtgggtgcctataatcccaggtacttgggaggctgaggcaggagaattgcttgaacccgggtggcagaggctgcagtgaaccaagatcacgccactgcactccagcctgggtgacaaagcaagactccgtctcaa

SEQ ID NO: 262589 - DNA, 865 bp, Homo sapiens
gtcgaggcgggtggtgaatcggcaccgagggtgtgacagtattgggaggtggtgcctttaagagatgattagatggttaagagggatgaatgccttactcttgcagtgagttcttgttctctcagttctggattagttcccatgagagtgggttgttataaagcaaggctgccttttgcgtttggtctcttttgcttgcccgtccacttttctgccacagtataatgtggcaggaggccctcaccagatgcagctgcctgatcttgaacgtcctagtctctagaactgtgagcctaataaacctctttcctttataaattacccagtcttaggtatattgttatagcaacagaaaacggattaagacatatgttgtacttgaaccttaatgtacttgaacttgaagtttgatggctgcagcagctatagccatcttacttccatgtgaagcctaagaattaagcaacacatggaagggaacacatcttttgagccccaatttggccatgagttgcccttagatttttttagttatgtgagccaatacatttcctaaaacaggtaaaattatgtttttagacactgataaccaaaacaggtcaaactatgcttacggcaatttgctttaaaagagaactagacagagagaatttgttgccttttgaccaatgcttccatgagagagctgatattctgattcctgacctcaaccactatttgattggcagatgtacacttacacactgcataatgacattttggtcaatgatgggcgcttgagcccaggaggtcaaggctgcagtgagctgtcattgtgccactgcactccaatctaaatgacagagtgagaccctgtctcaaaaaa

SEQ ID NO: 262590 - DNA, 597 bp, Homo sapiens
ggacatactctgtggtaagcaacgtgtttgtaacctctttcctttataaattacccagtcttaggtatattgttatagcaacagaaaacggattaagacatatgttgtacttgaaccttaatgtacttgaacttgaagtttgatggctgcagcagctatagccatcttacttccatgtgaagcctaagaattaagcaacacatggaagggaacacatcttttgagccccaatttggccatgagttgcccttagatttttttagttatgtgagccaatacatttcctaaaacaggtaaaattatgtttttagacactgataaccaaaacaggtcaaactatgcttacggcaatttgctttaaaagagaactagacagagagaatttgttgccttttgaccaatgcttccatgagagagctgatattctgattcctgacctcaaccactatttgattggcagatgtacacttacacactgcataatgacattttggtcaatgatgggcgcttgagcccaggaggtcaaggctgcagtgagctgtcattgtgccactgcactccaatctaaatgacagagtgagaccctgtctcaaaaaa

SEQ ID NO: 262591 - DNA, 861 bp, Homo sapiens
gagatggagtctcgctctgttgcccagtgtgacagtattgggaggtggtgcctttaagagatgattagatggttaagagggatgaatgccttactcttgcagtgagttcttgttctctcagttctggattagttcccatgagagtgggttgttataaagcaaggctgccttttgcgtttggtctcttttgcttgcccgtccacttttctgccacagtataatgtggcaggaggccctcaccagatgcagctgcctgatcttgaacgtcctagtctctagaactgtgagcctaataaacctctttcctttataaattacccagtcttaggtatattgttatagcaacagaaaacggattaagacatatgttgtacttgaaccttaatgtacttgaacttgaagtttgatggctgcagcagctatagccatcttacttccatgtgaagcctaagaattaagcaacacatggaagggaacacatcttttgagccccaatttggccatgagttgcccttagatttttttagttatgtgagccaatacatttcctaaaacaggtaaaattatgtttttagacactgataaccaaaacaggtcaaactatgcttacggcaatttgctttaaaagagaactagacagagagaatttgttgccttttgaccaatgcttccatgagagagctgatattctgattcctgacctcaaccactatttgattggcagatgtacacttacacactgcataatgacattttggtcaatgatgggcgcttgagcccaggaggtcaaggctgcagtgagctgtcattgtgccactgcactccaatctaaatgacagagtgagaccctgtctcaaaaaa

SEQ ID NO: 262592 - DNA, 346 bp, Homo sapiens
gcatcttcttaggttagcattcccagatagcttcatcagaaaagttcaaagatatccatgtcaggtgtgttaatgaaaataaaaaagctgggtgtggaatcccaggactttgggaggccaaggcaggtggaacatttgagctcaggcattcgagactagcctgcgcaacatggggaaactccatatttacaaaaaaattacctgaacatgatggctcatgcctacggtcccagctactcagaaggctgaggtaggaggatccttgatcctggaaggtcatggctgcagtgagcctagatagcacgactgtatgccagcacgggtgatagagtaagaccctgtctca

SEQ ID NO: 262593 - DNA, 508 bp, Homo sapiens
gagtagctgagactacaggcacacgtcaccacacccggctaattttttgtgtttttagtagagacgggggtttcactatgttggccaggagggtctcgaactcctggcctcaagtgatccgtgtgactcggcctcccaaagtgctaggattacaggcctgagccaccacacctggccaagattttcttttttgttcctacgtataagtgaggacatgtaatatttgtcatgctgtgcctggcttatttcacttaatatacagacctgtaatctcatccatttttttctgcagtggagaggattttactcctttttaggctgaataatacttcattatgtgtgtataccatagtttcttaattgaaacaaatttctaaaaagcaaatatttttaaaatgtctcagaatgcgaaactttagggatactgtgcccattttattcttttctacttcccattttatgtatatgcaagtgtatgtaataaagcagcaatcaatgtatcaatcta

SEQ ID NO: 262594 - DNA, 245 bp, Homo sapiens
gagaaagatactctgctagcttcagattcattagtactaggaaatggagagataggaggtataatgtattagggaagcaagggattcagaaccaggtgcccactgactctgagaagcactggatgcacagagggtagcagacaagcaagagggtggaatttgcagcatctcatcttggtgagacagttggaagacttttctgccaattatagtggttaaacactgactcaacatcaaacaacggc

SEQ ID NO: 262595 - DNA, 196 bp, Homo sapiens
ctccagagccccctatggaggcagaaccttctccaatccagcaggaggccacagttcagactccagagccccctatggaggtagaaccttcaagccagcagctggtcccagctcagcatccagagtcacctaaggaggttgcagctcaacctccagtgcatgagatgacaattccaatagcaggccaggaccaagc

SEQ ID NO: 262596 - DNA, 297 bp, Homo sapiens
acccttggtttggggtcctgccctcctgaagccaggacagataagagaaaccactcccagcaaaaagttcccaggggtaggtgcaacagctcatgccggtactcccagcactttgggaggctgaggcaggaggattgcttgaggctgagttcaagatcagcctaggcaacatagcaagaccccatatcttttctattttttaaacagggtctcaccctgtcatccaggttgacatgcattggtatgatcttgactcactacagtctctgcctcctaggctcaagtgatcctcccacc

SEQ ID NO: 262597 - DNA, 1018 bp, Homo sapiens
cggccgcccgcctccccggacgagccgtcggtggccgcgtcgtcggtgggcagcagccgcttgccgctcagcgcctcgcttgccttctccgacctcaccgaggagatgctggactgcgggcccagcggcttggtgcgggagctggaggagctgcgctcggagaacgactatctcaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagaggtgaggacctcatgcatccagcagggccagcctagggcaggtgggcacatgcaagcccccccaagccagtgtctctgtgagcccccgcttgtgggaaatgggcagcttatgcctccctggcaaggttgtttattcattcattcctccaacatgcatttcctgagcacctactgtgtaaattgtgtgctggacactaaggttacaatggtgaacaaaacacacccagttcctgtcctcagggagctcacggggtaatgagagagagagtcattcatcaaagaaccacagccgctgtgggaggattaactgagaaaacatgcaacaatgtcaggcatggggctcagccctctgtgcctcagtttccttacctatacaatggggcagtggtgccctgagtcattgtgaggaccaacaggaataacgcatgtggagtggctgcaagagactgcgagatcct

SEQ ID NO: 262598 - DNA, 603 bp, Homo sapiens
cggccgcccgcctccccggacgagccgtcggtggccgcgtcgtcggtgggcagcagccgcttgccgctcagcgcctcgcttgccttctccgacctcaccgaggagatgctggactgcgggcccagcggcttggtgcgggagctggaggagctgcgctcggagaacgactatctcaaggtgggggcgcccgggtagaaagggaggtcgcaggggtcgccggctgtcacagtcccgcgggcctgaggcaccagccggccctccttcccactgaacaatccggagaaaggggcccaagccctctggggaccactctgaggtggatctggggctccctcattccccccgccccctctcaactttatttgggaagcgcgctcctgaaaaagaccttggaactggctacagggccctaacctgggagcggggacttgagaaagctttggagcgttctgggaggcgttgctgaggtgggggtgggtagccagggaagggatggatctctgccttcagctgcccagaacctccacgcccaggctctccttcttgggacgggattgatagacaccgccgccagggaaacctgtggccatcccctgcccagga

SEQ ID NO: 262599 - DNA, 953 bp, Homo sapiens
ggctaacacggtgaaaccccgtctctactaaaaataaaaaaaaaaaattagccaggcgtggtggcgggtgcctgtagtcccactttctggggctgtgctgtgatacagatgctgagagcttgcggtacctaggtttgggttttggttctactgcttccttcatgagtttcttggtctctttgtgcctcagtttgctcatctgcagcgtggcagtgatgcgataggaacctgcctgtctctagggttgccctgctgtgaaagtcgggtggtcagtgggacttgcagtgggggctctcctcagcctgctcacatccttctctctcccacccctgcacaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagaggtgaggacctcatgcatccagcagggccagcctagggcaggtgggcacatgcaagcccccccaagccagtgtctctgtgagcccccgcttgtgggaaatgggcagcttatgcctccctggcaaggttgtttattcattcattcctccaacatgcatttcctgagcacctactgtgtaaattgtgtgctggacactaaggttacaatggtgaacaaaacacacccagttcctgtcctcagggagctcacggggtaatgagagagagagtcattcatcaaagaaccacagccgctgtgggaggattaactgagaaaacatgcaacaatgtcaggcatggggctcagccctctgtgcctcagtttccttacctatacaatggggcagtggtgccctgagtcattgtgaggaccaacaggaataacgcatgtggagtggctgcaagagactgcgagatcct

SEQ ID NO: 262600 - DNA, 622 bp, Homo sapiens
gttatttcaggtgaacatgcagatttattttctctgcctacggctacttcgttgtctattccttccctgcccatcattatccttccctctcttttatgacacttgtatgtctccatgtccatctggctggggtccctttgatgaccctgttctccctgctcttgaattagagaccggtggctattgctgagcctgtccccgccacagggccttcttcccatggtgccctctccttggactttcttcttccagtttttctcatgggtggctgctcagcattcaggtcatgtcagctcaaatgtcacttcccccaggaggcctgccctgatcacctccctgccgagggagcccgtccttgcccaggcacaacctccgtacctgggtatctccctcatagtgcagctaactttctaaatgatgctgttttcgtctttgccatccttcttcccccagcactggaatgcaagctctgcaaaactgaattcctggtatccttaaaagtgactggcacacaattggcactcaatatatatttgttgaagaaataaatcagaggcagagacaatgtgcaaacacagggcctcctgacccccaggccactgtcttgtgactacgcgatgtg

SEQ ID NO: 262601 - DNA, 428 bp, Homo sapiens
tgagggtaagtttgaaaaatgattacatacctattttaagtacctttgaaactgcattttatgagtgcctcttaaaaccaaagacgagtgtaaatgccattgtgttaagttgtctctgaagtaaacttaattatccacatgtttggcctgcacgttaccttgacccatagccagaaactaactcagggaaacttcagagataataggaccctagagggcagatacaggccaaggttagagtacagtatttgtcccatcctgaattcacctaggaaggtttgctgtataatgcttatgttccaattttgttacaggaatctagattctggtttcctttcttatcctaacactaagcccacaatagaaatagtgaataattcattctagcattcagaaaataatcaaaatgcatttttcttatcaatata

SEQ ID NO: 262602 - DNA, 226 bp, Homo sapiens
atggtccaatgactccagcttccagacaaagtacagatatatcctgcacatccactgttcataaatgatatgccaccataatggctcttgaaaataccttcttttgggccaggcacagtggctcacccctataatcccaacactttgggaggccgaggcaggcggatcacctgagatcgggagtttgagaccagcctggccaacgtggtgaaaccccatctctact

SEQ ID NO: 262603 - DNA, 792 bp, Homo sapiens
ccacctctctttggaactgtcataattctaaaggtttggggaggaaaccttagttctcttcatatacattaagttttaaatatgagttggtttagctatggcactggcattaacacaagccagagataggtggaaagtccatcaagccctatagcctagcataatcaaacctgaaccccggggtacagcacacacccagcagtccataaagcgctcttcagtaaccgactttgtcaaaaataaaaaaataacctggaagaataaacagtcctctttggaacagggcagactcttggatctgttaacctctttaagcctcagtttcctcatctgtgaaacagaaataacctcctgggaagaggttgtaaggtttaaagagaaaatgaagagccttccacattgtgtaggggagagttcctggtccattagcccttcataaaaaccagtgcctgccctttccttccaacagaagaagggggtggaggcagataagacaagacacgaaaacgtgaattccatcgattgactgcgaggggctagggttcacagcaagcagaacgtcctgggtttctcttcaataccacctcctcctctcctgttcagatgctgagaaacatctggcgcagtagagatgctgcctctgacatttctatgacaaaacgcgtgcctgtgctagggtttgcacaggcacaagttatcacaacctcgggatggggctggggatggcggacaggagctcctttaatttccccagctggcctctccccttgtgaggaacttctcattgcaata

SEQ ID NO: 262604 - DNA, 922 bp, Homo sapiens
tttaattcctaccatcttggccattagaatactgggctttaaatttaagagaaagggaaatggctgaaaggcccaccacaaaattacacagtggcaaaaccaggagaaaagctctacagttctggagctccttgtaaactccttgggcgactggaccaagttttccatcactaccaacctttccctagccccaacttgctgagagaaggaggaatcactaactgtactatattgccatattcactaagaacagtcagttcagggcaactaagaactactttacctctctggatgaggggaggaagggaaggattctgttcttaaacatcatcattattagttaacatttgttgaatagcaactatgtgctaggcactgtgccgagtatctcatgaattatctaatttagtcctcatggtttgaaaccaggaggcactattattattcctagcttgttttgtttagtttttttacagacagctgtctagctctgttgcccaggctggagtgcagtgatgcgatcatagctcactgcaggctcgaactcttgggctcaagcgatcctcccacctcagcatcccaagtagctaagaccacagaagaagggggtggaggcagataagacaagacacgaaaacgtgaattccatcgattgactgcgaggggctagggttcacagcaagcagaacgtcctgggtttctcttcaataccacctcctcctctcctgttcagatgctgagaaacatctggcgcagtagagatgctgcctctgacatttctatgacaaaacgcgtgcctgtgctagggtttgcacaggcacaagttatcacaacctcgggatggggctggggatggcggacaggagctcctttaatttccccagctggcctctccccttgtgaggaacttctcattgcaata

SEQ ID NO: 262605 - DNA, 420 bp, Homo sapiens
ggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgcca

SEQ ID NO: 262606 - DNA, 464 bp, Homo sapiens
cagccacatcagggagaagaatcaatggaaatgaagtctgtccatggactaagtatgggcccctatgttcctggaactgtgtaagcctgtgattcttgtaggattccatgcaggggagtaaaagggcttgaataataactgagatttgatttcctgcaagatatgcaaaagagggctcaaagtgggtgacatacggcttagaataataaggaatataacctgtcttacactctggtgttatgaactcagtgatagctacaactgattacataagaaactgagaaactgagatcaaggcatgttccatgccatctccagaggtccccgcccagaagtgctcaaccaaattaattccaaattaaggagattttgtattacatgtgtttataaaatggaagaaatttttgcctcttcccttcccttttcctctaagactaatttaaatacaagtaatttaaaagtta

SEQ ID NO: 262607 - DNA, 346 bp, Homo sapiens
tcggcataatttgggaagtggttaataagggagtatttataaaggcatggcttagggaaacctggaacctagaatgaagttatattgagagggttaccttcatcagagctgagatcacccacatggagggagctggaggaataaataccctgacctcactcctcaattccactctgccaggactttttcttggccatactcaaccagaaaccaggaagcaagagaacctattgatacggtctataagggtcaatctccaaataatggagcagggtggatgatctgttgatctggaggggcaaatggaagaactgcattaataaataatatcatttcccatttgtct

SEQ ID NO: 262608 - DNA, 120 bp, Homo sapiens
tttctcatctgtaaagtgactaaatgttaatgaggtgaatatatcagagatggctttgattctaaaacttctatttctaaaactgtgcaataaatataaaaatgcttaccaaataatcta

SEQ ID NO: 262609 - DNA, 367 bp, Homo sapiens
cagggggcaagaacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggttaaagcccgaggatcgcttgcaagtcttactgggagactgcagtgagtcacgattgtgccactgcactccagcctggtgacagagtgagcctctgtctcaaaaaaa

SEQ ID NO: 262610 - DNA, 2303 bp, Homo sapiens
tggcaaccttgcggcttgagtctgtcgacctgcagagctccaggaacaacaaggagcaccacacgcaggagatgggcgtcaagcggctcactgtgcgccgcggccagcccttctacctccggctgagcttcagccgacccttccagtcccagaacgaccacatcacctttgtggctgagaccggacccaagccgtcagagctgctggggacccgagccacattcttcctcacccgggtccagcccgggaatgtctggagcgcttctgatttcaccattgactccaactctctccaagtttcccttttcacaccagccaatgcagttattggccattacactctgaaaatagagatctctcagggccaaggtcacagtgtgacttacccgctgggaactttcatcctactttttaacccttggagtccagaggacgacgtctacctgccaagtgaaatactgctgcaggagtatatcatgcgagattatggctttgtttacaagggtcatgaaagattcatcacctcctggccctggaactacgggcagtttgaagaggacatcatagacatctgctttgagatcctgaacaagagcctgtatcacttaaagaacccggccaaagactgttcccagcggaacgacgtggtgtatgtgtgcagggtggtgagtgccatgatcaacagcaacgatgacaatggcgtgctgcaggggaactggggcgaggactactccaaaggggtcagtcctctggagtggaagggcagtgtggccatcctacagcagtggtcagccaggggcgggcagcctgtgaagtacggacagtgctgggtcttcgcctctgttatgtgcaccgtaatgagatgcttaggtgttccaacccgtgttgtttccaatttccgttccgcgcacaacgtggataggaacttgaccatcgatacgtactatgaccgaaatgccgagatgctgtcaactcagaaacgagacaaaatatggaacttccacgtctggaatgagtgctggatgatccggaaagatctcccaccaggatacaacgggtggcaggttctggaccccactccccagcagaccagcagtgggctgttctgctgtggccctgcctctgtgaaggccatcagggaaggggatgtccacctggcctatgacaccccttttgtgtatgccgaggtgaacgccgatgaagtcatttggctccttggggatggccaggcccaggaaatcctggcccacaacaccagttccatcgggaaggagatcagcactaagatggtggggtcagaccagcgccagagcatcaccagctcctacaagtacccagaaggatcccctgaggagagagctgtcttcatgaaggcttctcggaaaatgctgggcccccaaagagcttctttgcccttcctggatctcctggagtctgggggtcttagggatcagccagcgcagctgcagcttcacctggccaggatacccgagtggggccaggacctgcagctgctgctgcgtatccagagggtgccagacagcacccaccctcgggggcccatcggactggtggtgcgcttctgtgcacaggccctgctgcatgggggtggtacccagaagcccttctggaggcacacagtgcggatgaacctggactttgggaaggagacacagtggccgctcctcctgccctacagcaattacagaaacaagctaacggacgaaaagctcatccgcgtgtctggcatcgcggaggttgaagagacagggaggtccatgctggtcctaaaagatatctgtctggagcctccccacttgtctattgaggtgtctgagagggctgaggtgggcaaggcgctgagagtccatgtcaccctcaccaacaccttaatggtggctctgagcagctgcacgatggtgctggaaggaagcggcctcatcaatgggcagatagcaaaggaccttgggactctggtggccggacacaccctccaaattcaactggacctctacccgaccaaagctggaccccgccagctccaggttctcatcagcagcaacgaggtcaaggagatcaaaggctacaaggacatcttcgtcactgtggctggggctccctgagacccgccctccagctgccctccctggcacccctgccccacctggctcctttctactcctggctatgtcgtcttggctccacctctgtcctctctctagcctgcctgggaatgaatgaagctctgttagaaacaccgtgtgctttgggaagagacaataaagatgtctttatttaaaaaa

SEQ ID NO: 262611 - DNA, 679 bp, Homo sapiens
ctgaaaaccatcttatccagcacacccagatttactttccttgtctcctccaatcaggcctcaaatcctctcttcagcctgccttccactccctgcccacctctagccatgctctccttctaggtgtcagccctgtgctgggtactggaataacaaatatatggactagccaagccccaagcacacagcctcctagagtagacacatgtaaaaataaagaatagagcacagcaagacaagcgctgatagtggtggatacaaggtatagaggtgcccggaggaaggggcctgcaggtcttgatggagagagggaagtcagggaaggcttctcagaggaggggctgtttgtgctgtcaagaggatgagctgtcattcaagtcatgtattaggccattatcacgttgctataaagaaatacctgagaatgggcaatttatatgaaagaaaggtataacaggctcacagttctgcaggctttataggaaacatggtgctggcatttgcttggcttctagggagggctaaggaagcttacgctcatggtggaaggcaaagggggagtaggcacatcacatggtgaaaaggagagataattaagagggagacgccacacacttttaaatgagcagatctcacgacaactcacaatcatgaagacagcaccaaaccacgagggatc

SEQ ID NO: 262612 - DNA, 300 bp, Homo sapiens
cactgaaggacgtttggattgtttctaagttttgactgtggcaagtaaagatgctatgaacattcatgtacacatgaatttgtaggcatatgtttttattttgctgggagaaaagcccaagaatgcagttgctgggttgtatggtattgtatgattgtttttcttttaagaaactgccaaattattttccagaatgactgtaccactgtacattcttattagctatgtatgagagatgtagtttctccaaatcctcaccagcatttaatattgtcaggattaaaaaaatgttttttactt

SEQ ID NO: 262613 - DNA, 380 bp, Homo sapiens
gtatgttatcctgctttgaaaactgccacaataagtcaccaaaacacgtaatgtaaaatacgaaagtggtggcaaagatcacctgacagaatggtccactagagacaaatggcagtagtgaaggagtctgtgtgtgtgtgtgaatgtgtgacatttattatgggtgttctttgtgctgagcatttcactgttgtttacttaatcatcacaattttgtgagatgcatgtcttattcctgttttaacaaggacaaaacaggtgcacagagattcagtaacttggacaagcccttagttgacaaatgggatttgattctacatctctctgactttaaaagttgtgctttcccattataagatgttatctgctattacattata

SEQ ID NO: 262614 - DNA, 536 bp, Homo sapiens
taggatactatatcactattagtttggacttcaactagtctatagatttttttctttattatttattttattacaggtaattggccttttaattgctattatatatgagagcaaaatagaagactgacattttcttattagttccaaataactagataagttaatttgcagatgtataaaatttattgaaatcacctttgacgtgttgtaacatttttaaaaaaatcattagttattgtgctgctgcttctcagatatttttcagtgccacgaaagcttttattatcagttcagtccctgcccttaaggttcatctgacctcccttccccttccacagatttgtattaagtgaatgattttttctgtataagcattgggggggattgggggaggtgggatttaaaggtgaataaggggtaggcccttcactaaagaagcgtatctcctgttaggaaactgactatctaagcatagagttgttgggttagctttgaagttgaagactgtgaatctgtgtctcaagtaaaaatctagt

SEQ ID NO: 262615 - DNA, 375 bp, Homo sapiens
caggcctgtactgggccacacaacaggaggtgagtaagggtgggtgagcgaagcttcatctgtatttacagccgctccccacattaccacctgatctctgccttctgtcagatcagtggcaacattagattctcatgtgagcacgaaccctattgtgaactgtgcatgcaagggatctatcttgctctgtccttaggagaatctaatgcctgatgaactgtcattgtctcccatcacccccagatgggaccatctagttgcaggaaaagaaggtcaagactcccactcattctacattatggtgagttatgtaattattttgttatatgctacaatgtaataataatagaaataaagtgcacaataaatgtaatg

SEQ ID NO: 262616 - DNA, 436 bp, Homo sapiens
ggttcaagcaattctcctgcctcagcctcctgagtagctggtagctgggactacaggcacctgccaccacgcctggctcattttttgtatttttagtggagacagggtttcatggtgctagccaggatgttttcttgatctcctgaccttgtgatccgcttgcctcggcctcccaaagtgctgggattacaggcatgagccaccgcacccagcctcctttactttcttaataaacttgctttcactttatggattgactcaccccaaattctttcttgcccaagattcaagaacctcttggggtctggatcgggacccctttcccgtaacaatgacaaagcacaggaaaccatctgagaagaagcattcactttgttctatgcctgcttttaataaacatttttaataataaagccatcttcctatgttaaatatt

SEQ ID NO: 262617 - DNA, 208 bp, Homo sapiens
acattaaaaatagaattaccatagatacagcaactatactctggatatatatccaaaagaattcaaagcaagaacttgaagagatgtttaaacagccattttacttacatcaccatagccaagagatggaagtaacgcaaatgtttatcaacagatgaatggattaaaaaatgtaatatgtacatacaatggaatgttgtgcagcctt

SEQ ID NO: 262618 - DNA, 677 bp, Homo sapiens
acatgctaccaaaatttattttaccattgactgctgccctcaatctagaacactaaaagaaatatttgttttactgagcaggtgtgccttaacctccctactcagaaagctccacatcaataaacatgacactctgaagtgaaagtagccacgagaattgtgctacttatactggttcataatctggaggcaaggttcgactgcagccaccccatcagtctgtgccaggcatggtgtcctcccaggaggcaaatccagagtctggctatggggaaagtgaccactttgtgctgactcgatcggttaaggagctgtccaataaccttccaagtacctgagtgagtgtgtaacttattgggttggccaagcctggtaaagctgttggactgagtacgtgattctttttaagtaggaaaataaagatatttgtacagaaaaaaaagtacttttattttactgtggacagctgctagagatatagtgataccactctcttctatatttgaattatcaaagtatgactttatgttactttgtatatttaattacaaaagaagactgtcctctgtagctttaaaagatgctgaaccctaccctttcccaatgtttacattaatgacaactgttaaattttgtttttataaagtaaatactatctacttaagacatgaagtctg

SEQ ID NO: 262619 - DNA, 427 bp, Homo sapiens
gttcttcctagatttcaaaacttaattcaaaaatatttattttgtgcctataaggacacattgcttgaatgagccaacaacataaatgttacactcaactgtgctttgcctgtagctcttaagatttttccccttaaattagtaaaacatacaaaattcagatggcagcatatggtgccttccatggaaacatttcctttaaattattgagaattctgcaatctgattccactttaataaacacatgaaaactacctcttacattataaatgtgtaactagctagattaagtattttcatatgctttgctgatttttccaataccttcaggagttagactaaatgctttatgtttaatcgaaaggtatgatgcatgctatttatcgtctattaagcatcaacttgaatatttccaaaatatgaaagg

SEQ ID NO: 262620 - DNA, 321 bp, Homo sapiens
caatatatataaacatttttatgtcatcaccaagtggaatttatcccaggaatacagggttggtttaactcccaaaatcagttaatgtaatacattatactaataaaggtcaaaacccatatgataatcaagacagaaaagcacttgacaaaatctctttgtgataaaactaggcataaaagggaatgtattcaaaagctaagaatcttgcttaacattgaaagactgaatgcattccccctaagatgggaagcaaggctctcaccacttttttttgaaattatactggaggtgcaacattgcactggaggtgcaatcagg

SEQ ID NO: 262621 - DNA, 667 bp, Homo sapiens
agtcacatgtaggtaaatgataacttaaaatgtggcaaatgtaacaggagcttctgcttccacccaagatgaataaattgggacaagaattgtcctcatgctataaacaactagaaaaatgaaaaaaaaatgtatgaaacaacagttccagatgttggagaaaggacagaggaggatatgctgccagagaaaagtctccacagtaaacctgctggaatgaatactattatttactcctcattttgcagagaagaaactggaattttagcgagaaaaagaagaaatctgtaaagggagaaaaaatgtaaatggtattttttggtgacagaatgcgtttcttcagctttgtggcaaactgcccctaccaccacccctccagcaaaaaaaaattgttggtgaagaacgcaatcacaaatagctttataaagagatgaaaatattgcctcacttctaagtgaggctggattttcagaatttttttttttgcaactttcatatgatgtccggtctggcaacacatgtggcaaaaatgaaggctacatttttccctagatagaagagcacatccaatgtttccaacatgatagttcagaagattcaacaactgtgaaaagtgctaatctcagaccattttaagagattatagagaaaaaaatgaaaaatctgg

SEQ ID NO: 262622 - DNA, 902 bp, Homo sapiens
aggtaatcttcaagagaaaattaaaagggagtgccatgacttgactagctacatataggttgtctttgtttaaaaaaaaaaaaagtattctctggaggctgaggcaggagaattgcttgaagctgggaggtggaggttgcaagtgagccgatatgacgccactgcattccagcctgggtgacaaagcgagactccatctcaaaaacaaacaaacaaataataagtaaagaaaagtataactcctaattttataggctatttttcttctctaattcatcttctgttgttaatttatgaaatttaaaatcaaagatggcttaaagtaaaaatatatctagaatttcattcaacctgacctacaaaaaaaaaaaaataaccctctggtaatgatgaccataaatactgtcttttcaggagcttctgcttccacccaagatgaataaattgggacaagaattgtcctcatgctataaacaactagaaaaatgaaaaaaaaatgtatgaaacaacagttccagatgttggagaaaggacagaggaggatatgctgccagagaaaagtctccacagtaaacctgctggaatgaatactattatttactcctcattttgcagagaagaaactggaattttagcgaggtcagtgatttgcacacaatacagagttctctacctgccttagcagagcacaggtgtttgaagcactaaatgaactccatggaaattttctattcccaacatttcccctaaagtcacctcaattttacatttccctttcttttcagtccttctgcccttccccactggaaagacctaatcatttaaccacaaaactgagcagagaactttcgcaattgaactggcaagaattattttaaatacatggcattaaacttctcttg

SEQ ID NO: 262623 - DNA, 553 bp, Homo sapiens
gtacggttcccagcagaactgagctggagtggccctgatgcaaatgaacttagatcccagctgcttgtgatggaagccaatcccagctttcccaagcttacaggttttttccagaagaagccaacttgatctcccggaacacgaattcagcaggctctcatctcagaactgcctccaatccatcccataccccttcacacttcagtccttggtattttctccgatcacaccttccactcctccttcatatttgcaagtctctccctgcagaatctgccccgaggagcaaaggacatttttccatggggaacagaattttagaatttccctttgtacccagtgagaaagactaaagtttggtataggaaataacccaaagacaaatctatacactgcatagaacacaggaagcctgggctctgaaaacataaaagacaccaaatcattcctggagcacttgtgaagttttggaaaattcctttaacctctctaaacctcagtctcctcatttgtaaaatgaacataataaatattttttcttgcctatgtcaat

SEQ ID NO: 262624 - DNA, 132 bp, Homo sapiens
gggaggaaaccaagactccagggtggagtgattggctgtatgtttcacctgcagccacgcgaggcccagaagtcttccagtgctttggaggttcacaagaaatatggtgactcaactggaaccacattagag

SEQ ID NO: 262625 - DNA, 435 bp, Homo sapiens
ctctagacctatcgtatactacacttgtatgcaacgtctgcaggataaactttgaaagggttgggattgccacagcaaaggatatgtgtgtttatttttttattttttatttttttgagacagagtcttgctctgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtatcaatatgctgtctccaccattcagatgccagcatttcagtctgagaatcgctttacgtggaaagtggcattggtaagaattggactaaaaggtaaaaaaaaa

SEQ ID NO: 262626 - DNA, 449 bp, Homo sapiens
  misc_feature (128)..(128): n is a, c, g, or t
  misc_feature (137)..(137): n is a, c, g, or t
  misc_feature (142)..(142): n is a, c, g, or t
  misc_feature (144)..(144): n is a, c, g, or t
  misc_feature (149)..(150): n is a, c, g, or t
  misc_feature (152)..(152): n is a, c, g, or t
  misc_feature (173)..(173): n is a, c, g, or t
  misc_feature (177)..(177): n is a, c, g, or t
ggatactaatgtaatttaatagcccatcaacagtcatttgagagtaccatgtttgtttatactgaacccaccatgcagataattaactacttagaaattttgatgactgctaatccttttctcatttntaactcatnggccnantgaanncnccctggcccaaattctccaanctgnaacaattaaacatcttcatatattcatatatatatagttacctttaatcatgtaattcaacaggaatagagaggacggggactatgaaatctcagctgtgatgcaattatgtctgcagctcaaaatagatgttcttttctccatctcaaaaataaaaaataaaaatttaaatggctttatagtacagcttatttaattttactaaacctatttgcttttctcctaacaagagcataggtgttttactgtgtgatccctgggatttatctcac

SEQ ID NO: 262627 - DNA, 206 bp, Homo sapiens
atcaacagaaaaatgggtaatcaaaatgttcatattcatacagtagaatattcagcaataagaaagtaaaaatattgataaaactcagcaacatagatgaatctcaggatattattatgctgagtcaaagaagccttacacaaaggagtacatactatgtttccacttacataaaattctagaataggcaagacaatggtaaaaaa

SEQ ID NO: 262628 - DNA, 359 bp, Homo sapiens
tatggtatctgcccaagattcaggagtgatgatgggaggagatccaacagaactttgttgtaaggcaatggttagagaaaaatgaagccctcgctttctggacttagttcattcaataaaccagtttcggccaggcacgttggctcacatctataatcccagtactgtgggaggctgaggcaggtggatcacttgaggtcaggagttcgagaccagcctggccaacatggtgaaaccctgtctgtactaaaaatacaaaaattagccgggtgtggtggtgtgcacctgtagtcccagctactcgggaggctgaggcaggaaaatcacttgaacctgggagacagaggctgtagtgagct

SEQ ID NO: 262629 - DNA, 795 bp, Homo sapiens
agaaaatgaatttgtgttatttaaatgctatttgtggtaaattttttaaatgctgtttgtggtaattttttttcctgcagcaatcaacaactagtacagttttcatggaaaataattcaacccagcaattccattactgggtatatactcaagagaaaataaatcattctacaaaatgggcacagatgggtgccatcgtgtggtagattggataaagaaaatatggtacagatacaccatgaaatactacacagtcatgtcttttgcagcaacacagatgcagctgaaggccatcatcctaagtgaattaatgcaggaacagaaaactaaatactgcatattctcacttgtaagtgagaggtaaacactggatacataaagatgacaacaataagccactggggactgctagaggagaaagaggggaaggagggcaagggctgaaaaactacctattagatactatgctcactatctggatgatgggatcatttgtaccccaaaccttagcatcatgcactatatctatgtcataaatctgcacatgtaccctcagtacctaaaataatagtttaaattatataaaaaataaaattaatgcatttgcaacaatcgttgtatctgctatactggaaattccaagatggttgaaaaatatgtatagacatcagagagaaaagcctgaaatcaagaatcctatacccacttctctaggtgtaagaaaattatttcaggaaatataaggattaaaagagtacacattccatctgagaaaaatacacagggaagaataat

SEQ ID NO: 262630 - DNA, 511 bp, Homo sapiens
ctgcatcctgcgtccaacccttgtctcatgctttatttttaagggaacgcaaactgaaacatagggggtcttaaaaatcacctcatccagctttccgcttaaagacaagactcccctccatatctttgcaagatagctgttcctcatcaacccaaggactttccagcaaaggggaatgtatcacctaataaagtaactcattccaattggtaatattgaaggtgttagaaagttatttattttgaagccacaatttacagtgttctgtgctctgggggtaccagagggaaaaaatctcccttctgcatttcagctcctcaattatccgaagacagcaggttctgccatctcttcctttcctcatccatcatttcccttgattttcttctcctgacctggtttccagctgtggtcttttagggctgaatagtgtgaacctctcttctctcttcgcagtgtgattttttcacagcttatggtccaacttgttcttttagtagatttatattta

SEQ ID NO: 262631 - DNA, 498 bp, Homo sapiens
cctctgcagctaacattttccatgtagaaagcagttttttaaattcccgaaaataatgcacataagaaaaatggctagaccatctgatctaaaactctttgttttaaataattaattttgaaaattgtaaacaaaaagggacagcgattcggatatattccccctagcaaacaaagaaggcaaatcctagctgctgctgggaacaaaaccaaaacttggggctctgaaagcagcccgcgacgggtgcgaaatcacagggtgaaaaaaggacctagaaataaactgagctctgcacacgcctggctcttgcctcgggagcacgcacctcccagccccgctctcagcagctctcactatttaaagccggatctggtgtttaaatggagaggcggtgacgtaggcctgaaaagcaccttcccatcctggcagagtctatattagagagcggcaatggctctatataaacagggcagccaaagggaggaggaccacaaggct

SEQ ID NO: 262632 - DNA, 2433 bp, Homo sapiens
  misc_feature (90)..(90): n is a, c, g, or t
  misc_feature (96)..(97): n is a, c, g, or t
  misc_feature (244)..(245): n is a, c, g, or t
  misc_feature (263)..(263): n is a, c, g, or t
  misc_feature (268)..(268): n is a, c, g, or t
  misc_feature (283)..(283): n is a, c, g, or t
  misc_feature (293)..(293): n is a, c, g, or t
  misc_feature (730)..(730): n is a, c, g, or t
  misc_feature (1182)..(1182): n is a, c, g, or t
  misc_feature (1241)..(1241): n is a, c, g, or t
  misc_feature (1263)..(1263): n is a, c, g, or t
  misc_feature (1293)..(1293): n is a, c, g, or t
  misc_feature (1296)..(1296): n is a, c, g, or t
  misc_feature (1336)..(1338): n is a, c, g, or t
  misc_feature (1767)..(1767): n is a, c, g, or t
  misc_feature (1883)..(1883): n is a, c, g, or t
  misc_feature (1885)..(1885): n is a, c, g, or t
  misc_feature (2041)..(2041): n is a, c, g, or t
caacacaataagtaactgctgaactgagtatcccctatcaccccacttgaggaaagggggcctcatgaacccaattcttacacttttttntgtctnncccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaagganngttcctgggacctcaganaccangctcagagcctgacntccctgcgangggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtgagtantgggctggggaaggggagggaggtctccctgagccacaggagtttatagttgggaagagaccagaccagacgtgcacacaggaccctgctgggcacccaggaggctcggaaccaggtgccaagcagatagaaagtacagtgtagggtgtgatagtgggatgggagcttcctggagtaggggatctggctctagcatagacaggatgcagagtccaggtgaggggacagcaggagcctttgtcaggaggcccccttgcccctccctgtttcatctagacccctcctctgcccttgtctctcccatgaccccacctggccttcctttaggagctgccgcttggcagccttcctctgggcctctgggactccttcctggaacttcctggggccctaaagcatgaccagatgatgaatggtccacctagggtcaggtgacccccttgtccaatganttttggcctgggggcagggctgtgtcaaccacacccccctccatgcccccagcatctanctcaacttgccttcccttgatncgtccacttacctgcttcttcactactttnttntctgtgatcctcaatgttcctgcctgtaaaatgggcatgnnnatgcagatcaaagatcataagaattcttagaacgtcgctgggcacttagaaattgctcagtaaaagttcacctggcctaggagcataagaatctctaccaggaacatgcttacaacagccgtaagaggctggtactagcattttgggaattggacaaatgaggacccagagggccagagcagagtgacatcttgagatggggagctggtaagtggaccccagcctggctgaccccagcacacagtggggaccctggcaggctgctggtgtagcagtgggtgaccgggtgatcatcactaggtacactcatttcatccagtccttcctggagtcagccgaggagttcttcatgcgtgggtaccgggtgcactactacatcttcactgacaaccctgcagccgttcccggggtcccgctgggtccccaccngcttctcagctccatccccatccagggtcactcccactgggaggagacatccatgcgccggatggagaccatcagccagcacattgctaagagggctcaccgggaggtggactacntnttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagngaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattc

SEQ ID NO: 262633 - DNA, 408 bp, Homo sapiens
caagaaagaaaaaactgctgcaaattaaactataatgtgacagtgattgtttaagacctactgaaatttcagaaatgttaacatgaggaaaaaaatgtacgtcttagaattggtatactaggaccggccgggcacagtggctcacgcctataatcccagcactctgggaggccgaggcgggtgggtcatgaggtcaggagttcaagaccagcctggccaagatagtgaaccccatctctactaaaaatacaaaagaattaactgagtgcagtggcaggtacctgtaatcccagctacttgggagactgaggcaggagaattgcttgaacctgggaggcagaggttgcagtgagccgagatcgcaccaccgcactgcagcctgggcagtaagagcgaaactctgtctca

SEQ ID NO: 262634 - DNA, 1833 bp, Homo sapiens
  misc_feature (1630)..(1630): n is a, c, g, or t
agcagaaattcatttgatttgcatttaagaaaaaatgaaaattaaaaaaaaaacaaaaaagatacatacattttgcattcactttgaagagaacagaagagattgctggcttgttttccatctttgatgtttaatgacctggccattttgtatagagtgttcactgcagcatgattgcgataatgactttaagtgatggtatttcttggtgaatttgttcagaaattagatgcctcctcaaatcatagctctatgtacaataagttgtgtaccaaatggaagttatcttttactttttcccatcaaatgctcagcaagttagatatttttctgttccaatttttctgtacataagggaaaagatattttttaatgacttttaaaaatcacagtggaaaaagcgtgctggttttattttattccttgcctaacgatggaggctttggttgctaagtcagcgataggttttttcctatgtaagaaaataaccagagcttggccaggcgcggtggctcacgcctgtaatcccagcactttgggaggctgaggcaggtggatcacaaggtcaagagatcaagaccatcctggccaacatggtgaaaccccgtctctactatactaaaaatacaaaacttacctgggcgtggtggtgcgcgcctgtagtccagctacttgggaggctaaggcaggagaatcgcttaaacccaggaggcagaggttgcggtaaactgagatcatgccactgcactccagcctggtgacagagtgagactccatctgaaaaaaaaaaaacaagcaaacaaacaaacaaaaaaaacagagatcataaacttaatacagcaactactacagctagacagcccagtaggtactccccttagctgatgagtttaacaagctggaagccaggactcattggattcagggatatggatttacacccctttatagcggtggttctgaactggggatgatttattccccaagaacatttggcagtgtctggaatttatcataacttttatcataaatgcggaggtgctgctagcatctggtagggccagagatgctgctaaacatcctatacaacagagccccccacccatcacaacaaagaattatccagcccaaaatgatagtagtgctgatgttaagaaaacccagctttatggcaggattttaaaattctgccaagatccttcttctttttatcatctgtattaaaatttgggggtcttaaacattgcttcaacaatgggctactgattaaggctatctacaacgtagaatacgtcagaaaacctaatcactgtctttcaaactggattccttagggtgctagggcttcctcggggtagatagagctgagcaaacaggcgcaattctggggcactgtctccattctagccagagcacctctgcttttaacttgagcctgagtttttttagtaagacctgatttcctaaaaaggaaggagggagggaaagaggaaggaaggaagaaaaatgggaggaaaagaaggaggtagttatcatctttaaaaaagtttgaggccaggcgtggtggctcacgcctgtaatcccagcactttgggaggccaaggcgggcagatcacaaggtcaggagatngagaccatcctggctaacacggtgaaaccctgtctctactaaaactacaaaaaattagccaggcgtggtggcgggcgcctgtagtcccagctactcgggaggctgaggcaggagaatggtgtgaacctgggaggcggagcttgcagtgagctgagaccgcaccaccacactccagcctgggtgacagagcgagactctgtctc

SEQ ID NO: 262635 - DNA, 1517 bp, Homo sapiens
  misc_feature (1314)..(1314): n is a, c, g, or t
tatgtgtgttattttctttaacagacagtgaaacagcagttttcatgtgccaggcattgtgttagggactttataaatattgactcatttaatccaatgtaattcatttaataccaattctatgcagtaggaaactgaagcacagagcttaagcaaattggccatagtcacacagctgctgagcgtgttgttaagcctgattcccttgtgtagttaagagcagtcagatgcaaattttcttttgtttgtttgagacagggtctcactttgtcgctcaggctagaatgcagcggcatgatcatagctcactacagcctcaacttcttgggctcaagcaatcctcccacctcagccacttgggaggctaaggcaggagaatcgcttaaacccaggaggcagaggttgcggtaaactgagatcatgccactgcactccagcctggtgacagagtgagactccatctgaaaaaaaaaaaacaagcaaacaaacaaacaaaaaaaacagagatcataaacttaatacagcaactactacagctagacagcccagtaggtactccccttagctgatgagtttaacaagctggaagccaggactcattggattcagggatatggatttacacccctttatagcggtggttctgaactggggatgatttattccccaagaacatttggcagtgtctggaatttatcataacttttatcataaatgcggaggtgctgctagcatctggtagggccagagatgctgctaaacatcctatacaacagagccccccacccatcacaacaaagaattatccagcccaaaatgatagtagtgctgatgttaagaaaacccagctttatggcaggattttaaaattctgccaagatccttcttctttttatcatctgtattaaaatttgggggtcttaaacattgcttcaacaatgggctactgattaaggctatctacaacgtagaatacgtcagaaaacctaatcactgtctttcaaactggattccttagggtgctagggcttcctcggggtagatagagctgagcaaacaggcgcaattctggggcactgtctccattctagccagagcacctctgcttttaacttgagcctgagtttttttagtaagacctgatttcctaaaaaggaaggagggagggaaagaggaaggaaggaagaaaaatgggaggaaaagaaggaggtagttatcatctttaaaaaagtttgaggccaggcgtggtggctcacgcctgtaatcccagcactttgggaggccaaggcgggcagatcacaaggtcaggagatngagaccatcctggctaacacggtgaaaccctgtctctactaaaactacaaaaaattagccaggcgtggtggcgggcgcctgtagtcccagctactcgggaggctgaggcaggagaatggtgtgaacctgggaggcggagcttgcagtgagctgagaccgcaccaccacactccagcctgggtgacagagcgagactctgtctc

SEQ ID NO: 262636 - DNA, 431 bp, Homo sapiens
acatagtcttatcttcttaaaaagacatcagtcattggatttaggcccaccctaattaattatgacctcatcttaactaaaaacttcttcaaagactgttttctaaggatacattctgaggttttagatgggcattaactgtggagcaagcactactcaacttagtacaccaataacacattaaaccccttgctgctttcagaactaagccagttctcagtccagagtctattgtttgaagaggaggtcatttttcacaaagtaagccctgaaagaccaatggtaagtgtacatgttagtaactctctccatcctctccacaatggatgtatagcatatattcagataactgtacactgtgttaaggggaattcccaaacattttcaagaatgacatgaatagggtctggggagacactgatatgtgagaa

SEQ ID NO: 262637 - DNA, 357 bp, Homo sapiens
agctagctccataacatatttttagagtggaggaagctgagtcatgtggggaagtgtgtgtggcttaatggtgttgatgacagaggacttcatggtgagtgaaacaataacatggaatcggaaacctttggcccagatttcgtttctggtgctaatcccagggtgctcacccttgggaaagccactttacctctttgagctctgttcttttatgagtaaaatgtagtcatcaagactaattttatagaacttctgtaaggatagattagaagatagttaatgcagaacatagcacatcttggtaatttaagaaatatttcttgggagtctgctttcaatcttttacttgtatttaag

SEQ ID NO: 262638 - DNA, 201 bp, Homo sapiens
tgtggcaggtgggggcagactgaccacaaggcagtgaggacccgatctggtccttctgtgtctcccaggacctgcacagagcaagtgcctgataacatctggggtgggagccacgaggagctacacacacactcggtccaccagactggtttccccagccagacctctgagcttacaatactgacagagcagcatgctctg

SEQ ID NO: 262639 - DNA, 631 bp, Homo sapiens
atcccagcactttggaaggccgaagcaggcggatcacttgtggccagaagtttgagaccaccctgaccaacgtggcaaaaccccatgtctactaaaaatacaaaacgggtgtggcggcacatacctgtaatcctagctacttgggaggctgaggcaggagaattgcttgaaccagggaggcggaggttgcattgagctgagatcatgccactgcactcctccagcctgggcgacagagagagactgttctccctggaagcttagaacgtacaaagcagactctgaatgtctttccaggatcacactctggcttccagcttcccctggaaggttcaggagagtatttgtcgcctggttgcttttacatcatgctgattagacctgcacacccgggcatgaaatgagtgtgattgcatcattttcatagaacctaatggcagctgtatgtacgtctaagacttcttttgtgtaagtcgaatgttcttcgaagtttccccacgtcatgatttatgtgattttccgtcttgatcaggaccttctgaaggagctcaagtatgtggctgctccacggttgatgagtctctggttaagcatggccttccagttcagggctaggggggccgtcacctcc

SEQ ID NO: 262640 - DNA, 371 bp, Homo sapiens
agggagatcgtacatttcctcaagcaagattcattcttatcttaccccggcacagggcacctagccgcatcttaaaggctgtcagaaattctttagtaagtagggaaactctttggagttttgcttcctggtaaggatgcaaaccaagattctgctggaatgccagacaccgtttaccaaaaggcgggtttgcttttcttccatgcgtaatgtccaacttggttctttctattcccctaactacaagtaaggccttgttaagagcctgtatctgaatcgtaggctctggattacagaattctacagttatttattaagtctcaggaaatatatttgtggtagttgtcacataaagctgatatactttagtt

SEQ ID NO: 262641 - DNA, 407 bp, Homo sapiens
agcactgggcggctggagtgcaggatcaggtggggagccctagactgcttcagtagatgtgtgaatctggatgtttctgagcactgcctctttccttcagtagtctccctgagaagcaccacatggctatgcaaaggataaacacgttgtgggggcgagacgggtctgagtctaaggaacaaatgacatgtggcttgaggccacactccagacacggaattgggtttgctgaaagccttgagttggggtctcagctagaccactgacttgctgtgtgatccttgggcaagttccttcaccatctcagtcctacatggagcttaataaaacctgctttgtcctgatgactaaatggagtaaggcagggaggatacactgtgcttggctcattaaagacatttaacaaa

SEQ ID NO: 262642 - DNA, 389 bp, Homo sapiens
gtgaagtgctgctgtgcacataggaagctggaaccccgcttgactctacccacaggacgaagtccttcaaactcacaggacctcttgagggaagcccagtcacccaaaggaacagatgattctctaacttcagatggcccacaccgcattccccttcgaggcagcccagcaacctggggaaggaacatagtgtggcgggaagagtcctgcccaaggccaccagcccaaaaggggcagaattggcacttgcactcaaggactttgcttcagccctgaacacagcctctaatcctgtactgtccaatgacaggcactagccccatgtaactatttaaatttgcagacattaaaatttaataaaataaaaattttacttcctcaaggtacta

SEQ ID NO: 262643 - DNA, 300 bp, Homo sapiens
aggtcttgcttgttcccaccacccaggctagtcttgaacacctggcctcaggtgctcctcctacttcagcctcccaaaggaaggattacaggcgtgatccaccatgcccgaccaccacccctgaaagtgcttgagtgtgccttgaacatacaaccttcccgtaagtagacccttctcctaatatgccctccttcaggcctcttcctggtgaacttacatcatcataaacattggactgggagtcaaaaaaaattggttgataaggtctactttttgccacgccatagtaccagtgatcag

SEQ ID NO: 262644 - DNA, 614 bp, Homo sapiens
cccccatcttcaaatccagcagtgtagcatctttagtggtttttttttttctttctttctttctttgagacagaatcttgctctctcatccaggctggaatgcagtggtaccatcatagctcactgcagtgttgattgctcccaggctcaagcagtcctcccacatcagcctcccaagagactatggtgtgtgtcaccacacctggcttttatttttattttttatttttattttttgcagagaatgcactaataataacaacaactgcagctaccattggtcaagtgctccatgccaggcactgttctaagagctgcgtgtgtattcctcatacattctcacaacagagaggtagtaatattatgatgttctttggtgtacaaatgaggacactgaggcaccaagaggtttagtaacttgccccagagcagtgagaagctggagatggaggacctgcatgaaatagaccatggggcagatgagggaacgttgctcagaagtgggggccatggtgagagagtcgggggcatgggcttatttgtgaattttttttactatctgtctcccaactagagagccagctccatgactgatccatctctgctgaacactc

SEQ ID NO: 262645 - DNA, 498 bp, Homo sapiens
tcgttgctcaggcggtcactctccccggacccgttctccacggacttgaggccggtcagctgctggcagctcatgaccgagtcgatcatcttcatctggttctccagggcggcaatgctggagatgaccgagggcggggagggcgggcaggaccccgcgtaggacaggagtggcttggccgggtcggtggccgcgtccttcagctcagcgtcgtcctccatggagttctcgtccatgtcgtcatcgtagctgctcagagtctccgcgttcttgtcgtcgtaggccagctcggagtccatggcatcctggaagccctccggcagcggcgtgttggggatctggccgcccatgtgcatgcggatgtgctgctgcaggaccacggcgttggtgaacttcttctggcagatggggcaggagtgctgcacgcgcaggggcggctttgcacggtgcacgccgaagtgcgtcttgaggttgcccttggtggtgaaggcgcggccg

SEQ ID NO: 262646 - DNA, 1026 bp, Homo sapiens
gtcacaaggttgattgattagttggggtgaggcaggaacaaatcacaaaggtggaatgtcatcttttgtggttcttcagttgctccaggccatctgggtgtatatgtgcaggtcacaggcttagcttgggctcagaggcctgacaatttataaaatacttcattcaacaatagcagaccacacattcttctcaagttcacatggaacatttgccatgacagatcacattctgggccataaaatacaccttagcaccttttcaaagaatagaaatcataccaagtactctttcagaccacagtagaattaaactagaaataaataaataacaaagttaactggaaaatcccaaaatatttggagattaaacaaaacactactaaataacacatgaaccaaagaagtctcaagaggcataaaaatattttaagctaaacaaaaaatataacttatcaaatcttgtgggatgcaggaaaagcagtgcttagagggaaatttatagtattgactacatagattagaaaagaagaaagatccaaaatctacaagcttcaacattaggaaacgtaacaaaaaattaataatcaacattagaacagaaattaatgaaattgaaaacaggaaatcagagaaaattttaaacatcaaaagctggttctttgaaaaaaaaaatcaataaaatcaataaaactttagccaggctaaacaagaggaaaagaaaagagacacaaattccaaacatcagaaataaaggaggggcatcactactggtaacatggctaataaaaagattaaaaggaatatcatgaacagccctacacccataaacttggtaacttagataacattggccagtttcttgaaaaacgctatctaccaaaactcaaacaaggagaaatataatctgggtgggcctacatcaattaaaagaaatggaatccataattaatactcttccaaaacggaaagcacaagactcagatgttttcactggtgaattctaccaaacatttaaggaaaaaaaaa

SEQ ID NO: 262647 - DNA, 356 bp, Homo sapiens
gatagtaggcatgttctccagaaagccccctctgacccacccttcacccccaaccaggtggtgccaagacatcctggcttccctcccacagcatgtaccacattgaattcaaatgactcatttgcttggtttcaagaacaggatttatgtattgttcgcttttgtattcccatcacagtatctggcagagtcattcccaataaccatttgttggattagtatataaatctttttgcactacagaatagcctcatttaacaaatatttgaactataagaataatttatggagaacaagttttcttcacagacttcaatatgctactcatggtccttgactccagtagtccaaaaaaa

SEQ ID NO: 262648 - DNA, 1616 bp, Homo sapiens
gagccaagctccgtcgcctggtcagaggcccgaagcaggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatattgcacagcaagagccaaggttccccaggatctttgctctcaactttgtggtgactctggaacagatgctggagcagaccatcccctggtggagatagttttagatgctgacaaccagcagggccctggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagaccgttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattaggtaaaaggaaaccacaggtagttaatgctgggggaagaggggggacatttttgagtgtttgctgtataaaagcaataatatgatgccttctgtataccactgagctaagctaacttgtgacttttaataaattacttttaaagcagaagta

SEQ ID NO: 262649 - DNA, 1500 bp, Homo sapiens
gagccaagctccgtcgcctggtcagaggcccgaagcaggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatattgcacagcaagagccaaggttccccaggatctttgctctcaactttgtggtgactctggaacagatgctggagcagaccatcccctggtggagatagttttagatgctgacaaccagcagggccctggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagaccgttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcaggtatgatgatacaaatatcagaactggaa

SEQ ID NO: 262650 - DNA, 940 bp, Homo sapiens
gtgaaatgctatgtcagggattttgaagttagatttcctgtcttatataattaaacagggagcagaaatgcttttaagacagtagggctgtccttccctaccatttactgtgagacactaggaaagttatataacctttttgtgcctcagttacctcatctgtaaataagaagtaataatagtgccaaccatataaagttgtgagtgcctggcatgcagaaagtaggtatttagtaaatgtgagcaggtattattttagaattaagcttcaaaaaattttaaaagtgagattaaataaatatgattaaaatgaatgcatatatattttattttcatttttattctcttttcttcataggcagttaaaagaagaaaataacaatggaaaagaaaaattaaggatcatggcagtgaaaacttcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgaggtacaattttcagattctgcagttatagcaaatagaatgttttttattggtaattaagacccttaattggccgggcatggtggctcatgcctgtgatcccaacactttgggaggctgaggcaggcggatcacgaggtcaggagttcgagaccagcctgaccaaca

SEQ ID NO: 262651 - DNA, 325 bp, Homo sapiens
cataagtttacatatgtttgtttttaaacttgcagttaaaaagagaattatttggctttaaatcatatctttctaaataccagatgagtagcttctcaaacaaggaagaccgttgcattggctgctgtgaggcaaataaattggtgatttcggaattgaggtacaattttcagattctgcagttatagcaaatagaatgttttttattggtaattaagacccttaattggccgggcatggtggctcatgcctgtgatcccaacactttgggaggctgaggcaggcggatcacgaggtcaggagttcgagaccagcctgaccaaca

SEQ ID NO: 262652 - DNA, 590 bp, Homo sapiens
gttagataatacattccccaaaataatttagcatgtgataaaaattattccatggagagtcagaagggactcagagaggtgtccaaaggcttgagggggagactttaagaactcctttaacatttctggatgatcttgtttgtgccacagttaagagcatatggttaagagcatagctcaggagcaggtctacatgggatgaattccatggtagctgtgtgagcttgggcaagttactggtcctctccaggcttcagtttggacaccagtagaacagggatgctagcaggaccactaggtggaatcctgtgaggattcaatgcattagtaggtgggaagtgcacagtaggtgcatttaagtgcaatggcccctggctggacaacagctctacaaaaaaagaataaaggaaatcaagaagaaagccaagactaaaaaggttagcaactgctcaacatcaccctcaaacctatttctaaacccagggctttctacagtaatgcactgctgccatgagaccaggggcccataactagaaggaatcaagtttagtttcatttcctcttgccatgctctatgacagggtcattaa

SEQ ID NO: 262653 - DNA, 283 bp, Homo sapiens
aagctgcccacatgaagagttgccctaggcccccgaatgtgactaaaacacagcccaagaaggccgctacagctgcaattccatgcctgtgctgaggcccctgcgtgtctagcgccactgtactcttcgactccaaggtgtaccattcatgtggaaggctatgtaaatcatgcttcttggagggaggccaggccacagccctgcaggtgggcacatcctgtatcagtccattctcatgttactgataaagacatacctaagagtgggtaatttctaaaggaaa

SEQ ID NO: 262654 - DNA, 538 bp, Homo sapiens
caccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgtgttttaaattcagtttcccaactacaggatggcatttgtagcctttcctaaaaatcaagttta

SEQ ID NO: 262655 - DNA, 350 bp, Homo sapiens
cttcaccttaaaaacaggaccaatactgtccctcttagggataggatcagtaaacacatcccagccttgtgctcagtggatggatatcactccctagaagtagccattagtatttattagtttttctaatgcaataccagaatactttttccattgaaataagatgctattttgcaatgctaaatttgttgacatcgttttccaacccaagaaatcttaatagcttcacaacctttgcctgcccatggtttatcattgcccaatctgctaattcctttactcaatgttttgccagtaagttgagtattagtcagactagtgactgccccagggttgtgctttctcattag

SEQ ID NO: 262656 - DNA, 239 bp, Homo sapiens
ttcttgctgactgaggatattctcagatcttagaggatgcctgaagttccttccatgtggctccctcacacagagttttacagatcctctctcaacagagtaccttacatcttcaagaccattaggaaaaacaaaatttctgacttctaaatcctcttttaaggggcttcttgagccacatttggtccacgagccatggtttgccaatacataggtcacagaaactttatatacatatg

SEQ ID NO: 262657 - DNA, 446 bp, Homo sapiens
atctgcaacatgaatgaacctggaaggcattatgccaagtgaaatatgccagagaaagacaaatacaactggcccttgaacaacacaggtttgaactgcacatgtccatttacacccagatttttctcaaccaaatgcagatcacatttgcagatgtgaaacccacatatttggagggctgaattttggatgcacaggttctgcagagtcaacttctggacttcagtatgtgcgaattttggtatacatgggggtcctagaaccagtcctccgagcataccaagggacaactatactgtatggtaaccaaactcacagaaacagagagtagaatgctggttgccagggataagggggtaggtgaaatgggaagatgttggttaaagaacacaaactttctgaggatctaatgtacagcacatggtgactatagctaataatactgg

SEQ ID NO: 262658 - DNA, 469 bp, Homo sapiens
agctggcccggcgaagacagacctcctggacttgaggccgacttcaccaaatccgccccgggaaaaggcgagggcaaaggcggggcggacagacccagctgcggctgagggactgcggtccctagcaaggagcagagatggggagctggatccgcgcagaaccccggaaaagcgccagcaggattgcaccgagaacaaatcctccgcaccctcgcccagggctggggcgcagtgcgctggtgctcctctagctgggcggtccctgtgctccaaacgagaagatagctgacttccgaatccttcactctttgatcctgacccaagccactcgtgccactaggagcgcatgcctatggaatactcgctcctgtctccttgtggtgaagccttccgctaatgcccagagcctcccaggctggattagtgggtaggagcaaaacaggatagtggagacaatcagcagagcagc

SEQ ID NO: 262659 - DNA, 532 bp, Homo sapiens
gtaaaacttctcacagaaaacatagggggaaagcttcttggcattggtcttggtaatgactttgtggtttgacaccaaaaacaaaggcaacagaaccaaaaataggcaagtgggacatcgtaataaaagctctgtacagaaaaggaaacaatcagcaaaattaaaaagcaagctgaagaggccgaggcaggcagattccttgagcccaggagctcgagaccagcctggacaacatgataaaaccccatctgtacaaaaaaatacaaaaagtagctgggtgtggtagcatgcatgtgtagtcccagctgcttgggaggcccaggtgggaggatccattgagcccaggagatcaaggctacagtaagccatgattacaccactgcattccatgctgggaaacagcaggaccctgtctaaaagaaaaaaaatgtgagataaaagtaaggaggctgaggcaggtagatcacttgaggtcaggagttcaagaccagcctggccaacatggtgaaacctgtatctactgaaaaaaaaa

SEQ ID NO: 262660 - DNA, 118 bp, Homo sapiens
acaaaatgcactggaaatttcaacaatagaatcaaacagaaagaagaacttcacacgttgaagacaaggcttttgaattaacccaatgagacaaaggcaaagaaaaaagaatttaaag

SEQ ID NO: 262661 - DNA, 249 bp, Homo sapiens
ccagggctgtttgagcagctctcccctaaacagctgtctggtggggtgtgcccaccggccacctgaggctgtgggtgagctgggcctctgggcggagtggcatctaaccgacttttcggtgtgggcacaaacggcctcccctgctcttacctagttaccacctgcctgaacccatgcggtctctacctggtgtttaggggtagtcactctctggctatacaggggcctttcagccccaaccttggggga

SEQ ID NO: 262662 - DNA, 376 bp, Homo sapiens
ccacagtcaaaatatttacaaagttcactccttctccctttgcagcctatctctcctcctctcacccccacagccccgactccaggcagccactgatctgatttttctatctataggcagctttgcttgctcaagaacttcataaatgtgataatacagtttatgatcttctgtggtttctttcgccgagtctgatctacctgggattcacctatgttgttgaatatgtgagtgggtggctcctttcattgctgagtagtatgctagtgcatgagtctaccaccatttgcctatccatttacccactgatgaagatttggattgtttccagtgttaggccattctgattaaagtctttatgaaaatttttgtaaaa

SEQ ID NO: 262663 - DNA, 442 bp, Homo sapiens
ttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacc

SEQ ID NO: 262664 - DNA, 196 bp, Homo sapiens
tcctgagctcaagtgatcctcctgccttggcctcccaccaagtactcggattacaggtgtgagccaccatgactggcccctccactctttctgtacttccaattgcctgatcccaggttccagtgatatctgctgtatcactttccttagttaggtggaaatatcaccaattaggatagtcaaaaaaggaaacggg

SEQ ID NO: 262665 - DNA, 705 bp, Homo sapiens
ttacgcaggacatggataccccagtcccagctgtgctgaagtgtcaggaagcctcccccgaccccaccctgaacaacagtgaggggggttaggtgtcctcaaaagatctactctgtcaactggagttgttgagaaactcaggaaagggaactaaaaaggataagaaagtggtgcattccagtgtcttcctgttctctgttgcagagagccagctggtggaccgcagagacagacttccagccagggccaagcccttcaggaagggagtcatgcaccaaactcagctaacagaccaccagggcaccactgggtctcctgctggggaacagcacacctatgggtgggctctaggggtggggtggcctggttgctggttctgctctgccacttcttagctggacttgagcaatttgtaacatttcttggctcagtttctccacctgcacaatcaaaatatcactaccttcctccaagattgcattaagtgtgacaatttatgtaaagcacttagtccagtgcctggcacctagtaagtactgaatagtgaaaacaatttaagtctaacaaatccacacaccatgacgtcagacaaattaggcatctttcattgctgttgtgaaaattgcgctaactctaaactctaacgtacatctggctcactgtctttctgtaagaccagtcagagcagcagctccttccttggta

SEQ ID NO: 262666 - DNA, 955 bp, Homo sapiens
gcccaaggagcagccggcagcttgacacagtgaccaattggaagcacagcagccacacgccatgaaacaagacggagtttcgctcttggctggagtgcaatgtcgcaatctgggctcaccacaacctccacctcccgggttcaagtgattctcctgcctcagcctcccaagtagctgggattacaggcatgcaccaccataccagactaattttgtaattttagtagaaacggggtttttccatgttggtcaggctggtcctgaactcccgacctcgggtgatcctcccacctcagcctccctatattattaatcttaagtctaaatgttctattagaaaagttacaatcacatatgcagcttgcattacattgctaatggaacacgctgctctaaaccagggattggcaaactatgggcagtggacaacttccagcccactgtctgtttctgtacagctggtaaacaaggaatggttttcacatttttaaatggcagaaaaaaaataatttgtgatacgtgaacattaataaaattcaaatttcagtgtccatgaagagttatattggaaaagagaacctacaaccattgcctctcccgctgcgtaagttcggcaaaggctcacgcttttgtcttttgttggatgaatgactaccaacacctaggacagtgcctgcacaaattaggtgccctataaatatttgttgagtcactaaattttaaaattctagattatggggactgtgtaggaaggacctcattctttagagaacatgaattacccactactacaactcgctgtgtccatccctaagccagaagagcggaggttaagaccccaagcaagcccacacgtaatgacacaggaatggaaagctgatgctcggcctggtctcctgctgagcctggacacaggcataggcactgctgcaatggcaagagaagctcaaaaagt

SEQ ID NO: 262667 - DNA, 572 bp, Homo sapiens
gcccaaggagcagccggcagcttgacacagtgaccaattggaagcacagcagccacacgccatgaaacaagagagccagctggtggaccgcagagacagacttccagccagggccaagcccttcaggaagggagtcatgcaccaaactcagctaacagaccaccagggcaccactgggtctcctgctggggaacagcacacctatgggtgggctctaggggtggggtggcctggttgctggttctgctctgccacttcttagctggacttgagcaatttgtaacatttcttggctcagtttctccacctgcacaatcaaaatatcactaccttcctccaagattgcattaagtgtgacaatttatgtaaagcacttagtccagtgcctggcacctagtaagtactgaatagtgaaaacaatttaagtctaacaaatccacacaccatgacgtcagacaaattaggcatctttcattgctgttgtgaaaattgcgctaactctaaactctaacgtacatctggctcactgtctttctgtaagaccagtcagagcagcagctccttccttggta

SEQ ID NO: 262668 - DNA, 239 bp, Homo sapiens
gatccacctgcctcagcctctcaaagtgctgggattacaggcatgagccaccgcgcccagccaaagttcatttgtttgttttttaagtctgagttactttctttctgttcagagccttttatgatgaaggctcaacgtaatggaaagtagagttcactctttaacctctttttcctttatacaacaaaatggtccaggctttagggtaatcagactcctaaacatatatagtatgtgac

SEQ ID NO: 262669 - DNA, 253 bp, Homo sapiens
gatacttggggagctgaggtgggaggatggctccagccctggaggcagaggttgcaatgagccaagatagtgccactggaggccagcctgggtgacagagcaagaccttgtcttaaaaaaaaaaaattgtgtcctgctagaaataaacactgaagagtttattttgtatctaagattaggtgtcttttactatcatgaaaacagtaaatggattacagaaaacaaccaaacagtagcccacttatttttttct

SEQ ID NO: 262670 - DNA, 386 bp, Homo sapiens
ttactttctgtgcagcgtacgcgtcctttttcctaagagcgccctaaacaagaattgaaaatgaagcaattcctggctaaaatattccttaacatgaagatcgctgaggccccaaagactcattagtttcccgaggtcacagactaattttactaaccacacaacctttagaatttcagtctcctcccacatgaagaaacgccggcaccttacaccgacaggaaaactacaattaagtgaggctgttctcctcaagcccgactgagttctctgtaattgtagggcatacctacaccctgttttagcattatgagacctgaaatacttttaaattactggcaccatttctcatctctgaattataagtttataatgctctatccctt

SEQ ID NO: 262671 - DNA, 234 bp, Homo sapiens
ctgttccccagcccctctcattggctctgctccaggtggagaagggggatgatgtctctgtcagttctgccggtttagcctagcaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaac

SEQ ID NO: 262672 - DNA, 1596 bp, Homo sapiens
ggccacgagagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagccgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccattacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctc

SEQ ID NO: 262673 - DNA, 1284 bp, Homo sapiens
  misc_feature (36)..(36): n is a, c, g, or t
  misc_feature (45)..(46): n is a, c, g, or t
  misc_feature (85)..(85): n is a, c, g, or t
gacctaaggatcctaagtacttgttctcgtgcccanccccgcggnncatttggccttcctgctagctgagaggaacagtctaggnaccacccttttctactgggtttctcttccaggatctgccactgaagcgggagggggtgggtcccagtagcctgcagtctgtccttccgactgtagctctctcattagaggagctgcaaggtgatgaaggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccattacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctc

SEQ ID NO: 262674 - DNA, 772 bp, Homo sapiens
ggccacgagagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtaccactggctggagatgcggaccaaaatgcgcatcatgggtttcaatgccgctgccatcaagccgctgaacgagggtgcagccgccgagctgggcgcggagctgctgggcgagggcatcatcttcatcaccgcctgcagctgcctgatgctggagtattggcgccaccagttgcagcagcgccgcaaggaaaaggagcgacgtgttgccagggaggcgctgcggggcgaggtgggccacttggggctggcgctcgaggagttgcaggcgcaggtgcaggcgacgtcgacgcagctcgccctggaggagctgcgcgctcagctgcaggaggtgcgagcccacctctgcctccgagacccgccgcctgcacccccagttgcgccggcgtccgagaaataggaggtctcggggccctggtcttggaggtgactgctgtctggactgcgaagtctctgtcttggcctattctccgcactgtcccatcctggaccggcccagctgacaccacccagtccttcgggggcgccggagagatcctgggc

SEQ ID NO: 262675 - DNA, 541 bp, Homo sapiens
gaatctgatgtttgagggcaggaagcatccagcatgggagaaagatggaggccagaagactcagcaaatctgctctttccaatcctacttttatgctggcaactgattagatggtgcccacccagatggagggtgggtctgcctctcccagtccactgactcaaatgtggcaacactctcacagacacacccaagaaaaatactttgcattcttcaatccaatctagttgacactcagtattaaccatcacacctgccttgtctgtctttaaaactctaagcaacatttttaatttatcttatccacatttccaagatagggctataccttggccttgtgagaacaagcagaatttaaagggtaaaataaagagcaattatggaagactaaaaataaaaatagaaaacaaattttgagctaccttacttcagtgagagttattgagctactggctaaactgagctgtcctgactaaaaatggagtaaatatgggcaagcaatttcagctctgagtgcaatggcgccttataaatcaactgg

SEQ ID NO: 262676 - DNA, 468 bp, Homo sapiens
ttgaatattgacatcttgtaccaaatcaaacaaatgctttaatcatactactataaacattatgaaatgaccttaaagattccccccaaacctggatacttaaatgaagacattaaagtttaagaagatctgtttagggcctagtgactattaattcttgaattcagaatttaaaaatgcgtgcttgaggccaggtgcagtggctcacgtctgtaatcccagcactttgggaggctaaggcgggcagatcacgaggtcaggagatccagaccatcctggccaacatggtgaatcctcgtctctactaaaaatacaaaaattagctgggcttggtggcacgcacctgtagtcccagccacttgggaggctaggcaggagaatcacttgaacccgggaggtggaggttgcagtgagccaagatcgtgccactgcattccagcctggtgacagagcgagactctgtctcca

SEQ ID NO: 262677 - DNA, 273 bp, Homo sapiens
atcttatgaaataagtagtagtattctaattttacatataaggaaactgaggctgagaaagattaagaaacttccttcaggacacaaaattcctttagggtgggtacaggatagcagtggcaatgcttggattcagacctaggcctatgattccaaacctcatgctctttcaactacattctctgtcacagtgagtgccaaataaatatttgaattaccataaactgctgtctcaagtgatactgcagtacagatgagtttacacatgggtaa

SEQ ID NO: 262678 - DNA, 341 bp, Homo sapiens
cggggagtttataagttgtctgtgagaggttcagaacaatggaaactactaagtcattaccagaattagaattctctttcctacctttattttttaaggcgaaaggatagcatttttaaagtagagtgtcgtgatcaccatgttcctgtcaatattagtgatcatttctgtcaatggaatacataattcagaaggaattgctaagcgtaaagatagaaactgcttaggccaggcggggtggctcatgcctgtaatcccaagcactttgggaggccgaggcaggtggatcacaaggtcaggagttcatgaccggcctatccaacatagtgaaaccccatctc

SEQ ID NO: 262679 - DNA, 378 bp, Homo sapiens
ctcagctcatttcaacctccgcctcctgggttcaagcgattctcttgcctcagcctcccaagtagctgggattacaggtgcttgcaaccatgcccggctaatttttgtatttttagtagagacggggtttcaccatgttggccaggcttgtctcgaactcctgacctcaggttatctgctcatctcagcctctcaaagtgctgggattacaggcgggagccactgtgcctggcacctggacatttttacactctgtttcttagggactattcttggtatccactgtctttttttttttttttttgagacgggagtctcgctctgttgccccaggctgtagtgcagtggtgcaagcccacctcccaggttccagcaatt

SEQ ID NO: 262680 - DNA, 699 bp, Homo sapiens
ctggtcataggccaggcttatgaactagataccatgttgtatttagatgctgggatggcctggtctagatgctgggatggcctggtcagagttatggggctctcagtacttttttcatttcatgaagatgcaacagtcacttttataaagatgataattaatgagaaaaatattttttatcaagtacctaccatatactaaggcattgggacagacatttttcaagcattatctactgtatttaaagtttgccttgtgaaataggttacttattttgtagcaaaggaatacttattcctttatctttgagacagtttggaaacctctctctgaaaccgtgatatcactgttctcactgtggattttggatccttccagactcagcctacaataactatttctccatctgcccaccagtcccctttctcagctctccaaatttcaatcacacccttatttgtatcagatctaccgtcatctctagtttgtgagctcctctgagaacagatagactcttgttcttctctgtatcacatagtgctgagctcaatgccttgtgcacatgggtctcaacaatatcctcagagctcatttcttaaaagcagaatcaaaaggtttgaataacacctttcaagggcatgtccttttgtactcagagtaaaggtagatttccatttattttaaatgaacatataagca

SEQ ID NO: 262681 - DNA, 729 bp, Homo sapiens
ctggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggattactgaagggagctggtgccattcctcttggccataaccaactgtagtgagtagtgtatgtggtatgaatccagtaacaagatctatggccgatcaaacaacccatatgattacagcatattgtaggtgga

SEQ ID NO: 262682 - DNA, 379 bp, Homo sapiens
tagacatcttatacctccttagcttcatattttgcctcatgggggactacactgtgtaattcactgaaagtgtctcaaaaaatgattaatgtacataggagtctttcaggaaatacttgttgaatgaattgtttagtgaataaatggctgctgactaaagtattgtattttgcaggtgaaatgtatagatgttgttcaggcttatatcaacagaatcaaggacgtgaacccaatgatcaatggaattgtcaagtacaggtgagcatttccactctctcaaggagtcatttatggtggtttttgttctacttctgtggtcatgccaccttagcatatttcctagattcttctttctctttgtccttcccttgttctcact

SEQ ID NO: 262683 - DNA, 575 bp, Homo sapiens
gcaatttaacaaacacatgataagccagcagctactgtatgccaggcatttttggtacacaaactctctgagttctcacaacaatcttaggtgacaaggatgaagaacataaggttcaggaagtctagtaactctcccaggatcacacaggtggttccaagacatacacacatgctctgaacttcatactgggagctggagaggcttagtaagaccaaggtctgaggtcacgtcatcaagagatggagaaatcaaatggaaactaaacagatctagccctttttcccccagatggctcaatgttgggccaggccaactcaactcactgaggtagactgtccttggtcttgaaagggccagagcctgttgattcaggtctggtcttccgttgtccttctgtattttgtcagggcagtaccctctgaaaggacttgggtccctcttagtgagcttcaatgtcccttccagcttctggaaggtcttatcctggtgtcctttcagattcctttatcagagtcttcttcccttcctgaagcctgagatctggtcctggtagagaggacacactttaaaaa

SEQ ID NO: 262684 - DNA, 365 bp, Homo sapiens
cctcaggaaacttacaatcatggctgaagaggaaggggaaggggaagcaggcacatcttacatggctggaggaggaggaagagagtgaagggggagggctacacactagtaagcaaccagatctcgtgagaactcactatcacaagaatggcaaggtggaaatcacccccatgattcaatcaatcacctcccacaaggcccctcctccaacattggggattacaattcgacatgagatttgggcagggacacaaatgcagaccacatcagatggggacttcatgttactctggaaaatccattgctacttagtatggaaccccatgaaatattaataaacctaaaatcagttaatacataatctt

SEQ ID NO: 262685 - DNA, 318 bp, Homo sapiens
tgggctgaccttgaacccctctactaccagccaagtactccttaaattcccctacagcataaatatgattgtttccacaccaaggatcgaggctaagagagctaagtctcagagattagagaatcacagtagaaggaagacaggcagagcatcatgggaagagtcatttctgcattaacacatggctcctacacatttcctttttgtgtgggtgtttgccttatctgtcaattcaactatgaagtccttgaagataaataccgaggttttttcctacgtttgtacacaacaataaattgttaaatttacttctcttct

SEQ ID NO: 262686 - DNA, 421 bp, Homo sapiens
gttcataatttttttcagaaattaaaaagctgagggacgctttacaactttttaaaataaaaagtatgtatctgaagaatacataacctacaaaaccttcctctttagtagggtatctgaaatttaaaaatgatgcaactatgtactagagtgcatattatcagcggttttgtgtttgaacaacttcattttgcctcgaataaaggatctgcgcatggtgaatgcatgctgccttctaaagcctgcagtcgttaaaagaacattaatcatttaaacaaggtcacaagcaacaaaggccaacgagggttcaaagtttacaggtccagggatttatcaggtagaaataggctacatttcaatattttgtaaaatatccttttatgaaagagctatcagtcatggtacaaggctggtaaaactc

SEQ ID NO: 262687 - DNA, 280 bp, Homo sapiens
tgcccctcactccgcctcccccagagccgctgctttgcctcgcttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttctgagtcttccggcggccgc

SEQ ID NO: 262688 - DNA, 300 bp, Homo sapiens
gatttatccatttttcactttctcttcctccttgactctaagcttcatgaaagtagaagtgtctttttttttaaattttatctttgcattgcagttccttgcacacagtagagactcaataaatacttcctgtatctgttgttaactactcagaagatcatcagaataacattctgattaagcaatggtaaatttatttgatttatatgagaaaaaagaacagcacataaatagagccttagcagtgcttcagatagacataatgggagattgtttatagggttgtgtggcctggactgt

SEQ ID NO: 262689 - DNA, 678 bp, Homo sapiens
ggatgagactgaagactattattctaagtgaagtaactcaggaatggaaaaccaaacatcatatgttctcactgatatgttgggattaagctatgaggatgcaaaggcgtcggaatgatacaatggactttggagacttgtggggaaggagggggcaccaaaatctcacaaatcaccactaaagaacttactcatgtaaccaaacaccacctgtacaccaataacctatggaaaaataaaacataaataaaaataaagtcccctaaatttatagaagtccaattttgtttgttgctttttttttttttttttttttttcgtagagacagggtttcactatgttggcaaggctggtctcaaactcctggcctcaagtgatccacccacctcagcctcccaaaatgctgggattacaggtgtgagccactgggcctggcctaatttgttatttttttgtagagattggggtctcaccatatttaccaggctggtcttgaactcctgacctcaagcaatcctcctgctttggcctcccaaagtactgggattacaggtatgagccactgtgcccagcttgttgcttgtgctttgaatgtaatagctaagaaaccattgcctaatctaaggtcataaagatgtatgcctatatatagctttagctcttacatttagatcatc

SEQ ID NO: 262690 - DNA, 226 bp, Homo sapiens
tgggggtggaataatttatacatgtgtaaaaacatttatttttctacatatttacttcaagcatgtgttaaaatatctgcaaacaactccagaccccctccccatcttatttttatcctaaaggcagtgttacatggatatccaaatgtttagagaggacaatcttaaatatacaaaagaatgataaataaataaataaataaataaataaataaaaaaaagattt

SEQ ID NO: 262691 - DNA, 440 bp, Homo sapiens
cttttgtaaattgtccagtctcaggtatgtctttatcagcagtgtgaaaatgggctaatacagtgcatttatttttttgaagcatgtccatactttccattggattctcaaagggattcaggacctggaaactttttgaaatactgctccatagtaaatggcacaaatctctctgaatcaaggatgtctctagccttaggcaaagctaggttgaaggacagaacagagagtcagcctctggagtgccctctataaggaaaaagaaaacattactagagtaagttgataaagtataaattcatctcactcctactggacactgcccttgagtgaaattaaaaactgaaaaatttttgacatatcttttgagcatttttgtaaaatacgcatgtagctatggccaaaattctggaataaaatggtacatatagccttaggta

SEQ ID NO: 262692 - DNA, 200 bp, Homo sapiens
ggaggtggattagttcccaatcttcaccctgataaaactcagtgcatctaactgagagatcccctagccacattaatcaaagctggggcctcagcccaccattgtgtattgtatctaaccacctgctttagctgcaactggtttctatctagggatacttcccctactggcctgaagcctggatcatcaagagagtaagt

SEQ ID NO: 262693 - DNA, 313 bp, Homo sapiens
agtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacat

SEQ ID NO: 262694 - DNA, 370 bp, Homo sapiens
atgtatagtgctttggtcatcttgtttggaatgtctttccaagtttaaataatgggattataattaaatttaattaacatgaaaatgttgtagtgcttttgggtataaaaatcaattatcactgggctagagaagtgctgaagtgcctgttcacagagatttctggttagtagaatgtaggtagtatagttttttttttttaattgtggttgttcactcacaattcatactttttacaagtgatcagaattgtcccgacagttaaaataagtgtgagcgggccgggcacggtggctcacgcctgtaatctcagcactttgctaggccgagatgagcagataacttgaggtcaggagttcaggaccagcct

SEQ ID NO: 262695 - DNA, 485 bp, Homo sapiens
cctgaggctggggatgggagtgggaggagtagatgggctccaggaggcaccgaagcagggcgtcagtgggtgcctggacctaaggtgactgtggtggcagggagcggtgaggaaggtggggtccagagcatcagagggcctgtgtgccctgctatggggtttgaacttgaccgtggcttttcactgaagattcctcagaagggtgcagtgccacggctgaggcctgtaattcagtgctgtgggaggcagaggcgggagaatcacatgatgctaggagctcaagacagcttgggcaacacaggagatgctgtctctctgaaatgaaaaattaacaaattagtcctgcatggtgccgtgtgcctgtagtcccagctacctggaaggctgaggcaggaggatcacttgagcccaggggctctaggctacagcaagctgtgatagccccaaagcactccagactgggtgacagagcaagacagtttctc

SEQ ID NO: 262696 - DNA, 422 bp, Homo sapiens
ataagagctcaaaatggaaaactcagaaaaatattaatatttgatgtgctagaaaaattggagattccaaaaggctcttgagaggttatggtaaaaagcaaaaagtggaaaaggagagccatagaaactaagggacaaaaaaggttaagacatccaggctttaagatatatataagacagatctgaaaacatatacaccaaactctcaggaatggctagctttaggaggtggcgttgaagataatagcaaaagaactgggaatttcaattttgtatttgaatgtttaaaacctgttctatatatattataacttcttgagaacttagtattttaaaataaaaagttaaaaagatcctcttaaaattgaagttatagtcaattgaaaataaaaatagatgaatcaaataagcttaatcagaac

SEQ ID NO: 262697 - DNA, 392 bp, Homo sapiens
tactcaatttcatgttcagaaatccaaagagcccgaggaacacatttcacagacttctaccagcaaaggaagcttgcatatttactctgcgatttggcaatttgagtttatttctgtcacagtaagatgttacaggaggaggagcaaactactagtgggttctccttttgaatctggaatgaatttactgatggttcatcatcttggccctgaaaaatactgttgtaacaatgaaactatatgtttttaaagtatttttaatggaaataacatagataaccataagaatatttttaaaaattaattttcatttttcttgcatacctttgcatttactttttatattcctagtagtggcaggagtattaataaagcaatgatgatttttgtca

SEQ ID NO: 262698 - DNA, 672 bp, Homo sapiens
atatggatgaaagggaagcatctttgaatataatttgttacacagttttgaccttggaatcatgtaaatgttttacatactcaaaattaaatcaaagagaaaaaaaatctagtgatcctcatacagctaaatgcttcatgtgataatggaacactgatatgttgcctatgccccattttattaaaatgaaccagactataaccttgacctagccaaatcatttttcttcagtaataaagtttccctgctatatttacttatgttttgctccaacatatctaaaagctaccatctgtaggtaataagaacagaacactatcacatattgttttaatttcctgcctgttatcagcagcaagaaggtaaccctggaaacagggatttatggcattctgtttcctacggttggtcacaaccacaaacaaaatgaaagcagcctccacaagttaaaggtttgtctacaacaacaccacacaatgtcagttttcaggtatacctttctcatgtcattcataattaagcaatgtcaacaaataacactgctgggtaacatccctcaagtatttagtctgccagacccttttctgaaagtatagtaagacaggcccacaatacaagcccaagtgcttttttttttctctcgagacagggtctccctctgttgcccaggct

SEQ ID NO: 262699 - DNA, 630 bp, Homo sapiens
aggatattttgtctggagtattttctagtagcaagtgatcaggtggacagcccttttttaagagcgatcttttcagggaggagaatggcagctaatgcggccagatggcaaagggatcctcagatcagagattttagggttaagaacaggaaggggttagagaccatttagtcaaaaccagtcattttatagaagagaaaactgaagctctgaaagttgaatggacttactcaaggttaatagaaactaacaactttctacccgatatctgtctcctcttcttccttactaacaaatccttgattttgtttagagtggcaatgttcccagaacaaaataatcacctccccagccttccttggagctaggggatgcatattacccatttctcacaaaggtgtaagtggaggtcactggatggggctgggggaagctttttaaggggaaacaaatgtcttgtgtgctcttgtctctacgttcctccttcctgcttgtaatgcagacataagattagctgttcagctctaacactgtggtttttaatcaggtgccagaatccattctgggtgtgaaaaaatgttcacttttagagcaatatctctttctggtaatccatcaagtgttgctaat

SEQ ID NO: 262700 - DNA, 358 bp, Homo sapiens
gagagaactagtctcgagaacctgggaggcggaggttgcagtgagccgagatcgcgccattgcactccagcctgggtaataagagtgaaactccatttaaaaataaataaataaatataaataaaaataaataaataaatacagaaaagcctgggagtttccttgacttcctttttccccctccctcttcttattcatcaaacatttgttgattgcctatataagccaagcactgtaataggtgctggtcatgacgacacaacagattatcactacaccagagacaaagaccaaagtcataacctctgaagcaggaagacctcactgattttagtgtcttcttctactttactgtgta

SEQ ID NO: 262701 - DNA, 414 bp, Homo sapiens
acagagagaaggattctattgcttgacacaactactgacctatctggcttgttttgtccatgtcagctctgctgtcctcactgccgatcacctatcctaagacttcaaccatgaatacttgcccaactcctgcttccattacttaaacatttccacatctcctgcagccactctatttgaggtggtttaaaaagagataaagtgagggaggctggactagaatgggtgctgctgacacttcaagcatgtgtgtgcacgcccttgtataattgtggtggtgctccaggttacattactctaccataaaaacctagtagtgttagttttgatctcctaagaacccagaatatcctccttcttccagaactactatctggatctagtagaaggtgaagtgtaactctgcacagtgaa

SEQ ID NO: 262702 - DNA, 566 bp, Homo sapiens
caggagtttgagaccagcttgagcaccatagccagaccctatatgtagccaggcaaaatggtgtgtgcctgtgaagggaggattcacttgagtccaggaggttgaggctgcagtaagtggtgattgcgccattgtcctccagcttgggtgatagagtgagactctgtctcaaaaaaaaaaaaaagaaaagaaaaaaacctcatatttatatagctctaaaccactgtgagttaggtagaatttgggggaaggctctctaacctattcttagtatggccagaccaccctttcctcctttcagatcttactgttttgtttgcagagatggacttcaaggccaaaaggcatactgtgttagggtctgtgtcaggcagccccttttgggttccaagagcagaggaagatgaggctgtgtgagggaagaccataggatgatagagaattggtaccgggcacagtggctcatgcccataatcctagcactttggaaggttgaagcaggtggatcacttgaggccacggcactccagcctgggtaatagagcaagactcagtctcaaaaaaaa

SEQ ID NO: 262703 - DNA, 966 bp, Homo sapiens
ttttctagaaacatacacaatgaagtcctgagagaagaacttttccctgtattcaccttagggttgtatgtgccgtagggcattcagatgaggactgagaaaaagccattggattggccattaggaggtctttggtgacttttgctgacaatcagggggaaaggatggggtgggagccctggtgtcctataaactgagcagagagttaatcaggtttgcaggcacattgagaaatgggtagtgatgggcagagtgaggttgggcttggaaagctttttgtgagaaaagtcagtttcaacacttcgataggggcagacctggggggatcattgacaaagtgacagttacattggataaactgaacttgatgaagagctgcctgcagtgttgagctggtgacaacttccctgcagagtggtatttgggagcctctagtctagtcgagtcctatataccggacatagctgcccctctttaaatatatcttcttaggaaatcctcactccttgtaattaacttctctaacagtcgagaagtttccttttgctgtggctccatgccttgtggagcccctcactcagtgagtttgtatagttccccaacccctagctttgtctgctgtaaattaaagacatttggtttcttatcgaactggaagggaggcctcagaaccaatgtttctttaggtgatagcagaacgttgcagatcatttttgatttgtgttttgctgctttaatatatttttctgacatatatgttcaaattcattcctttcataatttgtttttcttcctgaaatatctacctttaattccccatgttctcatcttgtgacttttatctatgtctttgcattttaattctgtcttccaaagtgcactctattgtcaaaaagtattgtaagtaccttttacaggtaagtgtcatcgcaggtagatttatgcttggttcttaaaacttaagca

SEQ ID NO: 262704 - DNA, 377 bp, Homo sapiens
tgtaaaaatattctcaggcatatgaaacatcacaggctttgccaaagacccaaatcaaaacatattcaaaggaaattctcattagttaatcggtccagaagatgctgtgtgaagttgaggtggtatagcttattgctaattaaaatttgagacattactaatataataggaaggggagacaatattggcatggcaatatgctaaaatacttattttactaggggaaagatatacatattaatcgttttaagaataaataggattaaataattttaagtatatacaagaaacccagccataaacaaaaatagaatatgtaatttttaagagacttgaagggtactcaagctatctaaccaagaaccaggagtgagggg

SEQ ID NO: 262705 - DNA, 447 bp, Homo sapiens
caccaccttccttagatctgaaggggggtgggtatggcattacctgaggtggtggtagccggaccccaggagactgacccctgctagaagctgctgtcagaaaagaaaccaagaacaactgagaggttagaaagttgtagattaaagttactttgacctctcttttctcctgcctttttgtcccctgctgattcttccctttggtcaaacccaaccagaatccagagggcaggtggtggtattgccctccagggctcagcctccagcccagagcacagtgagaagaacagacaatggacagggaggaagaggggcaaatggagagtacccactactcgggaggctgaggaaggagaatcgcttgaacccaggagacagaggttgcagtgagacgcgatggcaccactgcactccagcctgggtgccagagcgagactctgtcccaga

SEQ ID NO: 262706 - DNA, 414 bp, Homo sapiens
aggggtacactgtctttccaaactgttcctgctggttactttgttgcttagttttgagacagggtctcactctggttgcccaggctggagtccagtgggcaaccagagtgagactggggaaattaataaaacagtaagcaaacatacagaaaaaaaaaaatcaatgaaaccaaaaggtggttctttgaagagacagaaaattaataaatccttgccaaataaatataaggtataaggactgaaaaagaaataaaactcattattcacagatgctatgtccatatatacaggaaagcccaaaagaatctaaagataattagtaaaagtgagtttggcacagttgctgaatatgaggcatatatatatctttctaaaagatatataaaaatgcaaacaatccagaatagccaagac

SEQ ID NO: 262707 - DNA, 459 bp, Homo sapiens
gatggtttcagtaagatggaaaatcaggtcaacctatttgcagttcaacaataaggcccagatgttgttttcaggaagattcgtcagcaacgtaccctttgagggtgttgttaatgatcacacctaccagttattcagtctttaagatgccagatactctcttggattttttttccaatttttcttatcaaggtataatttacatagcatataacacccttcgatagctcaggtggtaatttacatagtgtatcttctgagtatcttccatctgttagttcatttaatcctcacaactgtgtcagaggggtactatgatagccccattttatagacgagaacgctgaggcacagttagcttaaataacttgcccaggttcccactgctaatacatgtagggatgtgcgtaagaacacagccagtgtagctggtttaacatcagcaagcagaacagtaaa

SEQ ID NO: 262708 - DNA, 639 bp, Homo sapiens
aacaggtaattgaggaatatttttaattcaatcctgtgagttcttgactcagttgctacagtgttgagtggttttggatagactttttgaagacaaaaaactttaaataacattggaaatgcgtgtactaagtgactagaacagttaacaagaatggaatagcacctgcaggtgggatagctgcagagttgggctatgtgtactgtgtgagagggagtgagggagcatggtcttgccttatgttccattggcagttcagaatttcaagagtttcaagcttgtttatattctcatttctgtacttccttttataatttttaagatgagctccttcattactgccaagagtatgttttctttttgcctttaccttgaggctgtcttttcacctgaggtacaaccaatatagggctttaaaaggctggctgcttgttatttcaaatggggaactttatgtataatagtttgctgtcatgtacctgtacttcaaaactgtattaagggaagacaactgtctcaataaaatcaccatgagaaaaattctttgctttgttatttcaaaatgttattgttttaagtctgcctttaatcatagctttaaaaatatttatttgctaataaaagaaaatgttgaatggt

SEQ ID NO: 262709 - DNA, 564 bp, Homo sapiens
ccatacaggagagatggagaatgctaggaaggtgtgtatgtgctaggggaatctggcccagtctcagagtgtcagggaagacttccctggaaacctgtcattggatccaggtggtaagtaaggttaaccatacacagatttgggagaatagccaagctgagaaaatagcttggatagaggccccatgaggagagggagcctatgggtgggaatacgaagattctgagagaaggccagtgaggctggatgtgtgtttggatgaaaggttccgaccattcctgaccaggggtcaacaaattatggcccatgggctgaattcagctacaatgatagagctgagtagttgcaacagagacattatgacccacaaaggtgggaagaaattcagaatgctgtctagaaaatgtattgtctgccttttatagaaaaagtttgcagccaggggcagtgtttcacacctgcaatcctagcactttgcgaggccaaggtgggaagatcatttgagctcaggagtttgagaccagcctgggcaatatagagagacttcatctctcctgaaaaatt

SEQ ID NO: 262710 - DNA, 971 bp, Homo sapiens
ttaaagcttggaactaaatctgtgactaattagaatggagtgttccaccacctttaagtcaccaactaaaatccactgctccatgtcccggtgcgcacgaggccttctgggtgaccagctcaaaggaaaattattgtctcaacttaggtctctgtgtgtaggtacccacagaatggaaatcgctttacttggggaagaacaagaggacaagatgagataaaaaggaagcatgtttaaatggataaaagaaggtacttttttcccccactacacacaattgacctggggaactcactgcagcaggatattaagatcaatggtgaagatttgtgttttaaaggattagacatttcacatgcatatcatcaacagtgaggctcaataggataaaagtacagcggatgaaagttctcaagcttcagtgtataagttgatcaccaactgggtcaggcaaaaagaaaaaagttgtctacctgattatctaagatgtcaagggacggtgggtttgggggtatttgggcattccagttaccactactgtgtaacaaaccactccaaattagtggtgtaaaacaagagccatttaattatgctcacggatgctgcaaatcaggaagcgggagagggcacagtggggatggctagtctctgccccatgctatctggggcctcagatgggaagacttgaacgacagggagtggcttgaggctgggggtagaatcatcagggagcttctttagtcatgtgcctgacacctggcctgggatgaccccgtctctacaaagaaaacaaacattagccgggcgtggtggcgcatgcctgtagttccatctactcgggaggctggggtgggaggattgcttgagcctgggaggttgaggctacagtgagccgtggtcgtgccactgcactccagcctgagagacagattgagaccccgtcgcaaagaaaaaaagaaaaagaaaaaatg

SEQ ID NO: 262711 - DNA, 468 bp, Homo sapiens
  misc_feature (225)..(225): n is a, c, g, or t
  misc_feature (237)..(237): n is a, c, g, or t
tggtggggaggggagtcagggagctgctgctttaaggcaggagtcttcttggcatgggtctgtcaacctcttctctcccccgggtctgtgcttccaaatgctggtgctgtttgcacacttgtgtctttggccttcactggttctgcttagaatctcccttccatgggtatctacctgaccatctgctcctcttctttccagtctgaaaaaaaaaaagaaaaaagnaattaaaaagcnaatatatatagagaaaaccttttaatggtaaaatgttcatttttaaaatctagatgcagggcagaaaagtcttgtcatgtttaaactcctctgggtttgaagtttctggaaatgaaaggtgtgggaacaggtctctggagcagcagtgtggaagacggggtactgaggctgaagtgagccgagatcgcgcccctgccctccagctgacatgagagaacaaggccctgtctg

SEQ ID NO: 262712 - DNA, 660 bp, Homo sapiens
ggaagcccaaccaagatcagcagagctgtctatccaaccccaagttcactgcaaattcactgcagagacaggaatgagcccacttgagactggaagagtcagatggttttatctgtagacttacgaacacaaataaatgcttaggccaggagctgtggcttacacctggaatcccagcactttgggaggctgcagcaagaggatcacttgaggccaggagttcaggaccagcctggccaacatagtgaggtgccagctctacaaaaaaaaaatggaagcagaggtaggaggattacttgaacctcagaggttgaggctgaagtgagccatgattgcaccactgcactccagcctgggcgacaaagtgagaccccaactccacactctctctctctcacacacacacacacacacacacacacacacacacaaataagataaaataaaaatgcttagtgcttgaagtcattggctgcagggctacttgttacgtacgcagcagtagctgactgatccaaccagcaatagcgtcatcatcaccatcccccacaatgggcacccacttgccttcaatatgaatctaagaggaatcattcaactgattctctctaaattaagaagttctgctcaaggagcttagctgtctccactgtacaaagg

SEQ ID NO: 262713 - DNA, 360 bp, Homo sapiens
ggaatatccccaactcagaagaaaggggaacatcgtgccttcaaatacgttgtctcaaatatttaaaaaaaaattacaacaaaaagggcaattttatgccactttgctttctgttttcttcaagttcagaattgaattattatagttatgtattccctcccaaaaggggcaaatgactttgtcacagataaccaacataacaaatcattcaaatagaaaactatggtgtgcgtgcctgtaatcccagctactcaggaggctgaggcaggagaatcgctggaacctgggaggccgaggctgcagggagcctagattgtgccacgcactccagcctgagtgacagagagtgactctatctca

SEQ ID NO: 262714 - DNA, 480 bp, Homo sapiens
gggacttctctgtttcagcaccatatagccaaggtatcttgagccttacctagttcatgcaatgcttggagccttgattctccatacacgaaagggaaataaaactctgtcttacagggccagcttgaaaatgtctacaaggggccaaggcaaatccctctcatgactatttcatctggaagtaaaaacttgtccttctctgaatgcccagaggggataaatagcagaagtagaatgactcaacttccttaataagatattggttgaaaaccaatcttctcccaacttcctcttttaagtcttcagcttgcctgccaccaggccacaataggcaaacctctgcctactcaaagtgcggggctgggctgggtgcggtgtgtcacgcctgtaatctcagcactttgggaggcaaggcaggaggatcacttgagaccagcagtttgacaccagcctggacaacatagtgagacttcatctcta

SEQ ID NO: 262715 - DNA, 321 bp, Homo sapiens
gaggtgccttccaggtgatcaccatggaaatgcctttcactggggtctccagagatgaaaaattcaggatatgtctatgtgaaatatggtcttgtaaaccatgggatagggatgggaaaagttggcttagtctctctctctctctccacctctggagtggcagctgtgtgactccctgtaaactttcaaatggtggttcttcatgcccggggatgattccgtgtgtcaacaagtctgggcagtctttgatgtagccaccagcgtctaggccaggaggcacactgctgctgcctggtgccctcatgatcattctctgtgcct

SEQ ID NO: 262716 - DNA, 394 bp, Homo sapiens
gcaacatctccctccaaaccagtattcagattcttctttcctctctaaactcttttgcctgaaaagagtgtaaagcaccactctggagacaatatagctgcatggaaattcatcaatatgaagttcctattatggaagaatggcaaggaaacgtgaaggactcatgaaacaaagtgttcagcagccatatgaataatcaattagatggagagccacctgatgctgcacatttggcggagcctccagctgccaccagttttctgccctgtcagtatcagcttaaaaaaatctgttccctgtttatcacgactatactcagtaaaataatctattcttttgcacctcaccccatattttcctacttgctaattagagatgcaaatgttgataaata

SEQ ID NO: 262717 - DNA, 445 bp, Homo sapiens
gaatgctcaaataagctaagggtagaagtagaaatagatctcaggtcgtgctgtgatgcgagtgatacatgtataggcatttgcttttgaggagcacaagtaatacaggagtacattctccttgtttagtattaaagatgtaaagaggggccgggcgtggtagctcacgcctgtaatcccagcactttgcgaggccaaggcgggcagatcacttgaggtcaggagttcaagactagcctggccaacgtggtgaaaccctgtctcaactaaaaatacaaaaattagccaggtgtgttggtgggtgcctctaatcccagctactcaggaggctgaggcaggagaatctcttgaattcgggaggggaggttgcagtgagccgagattgcgccactgcactccagcctgagtgacagagtgagactctgtcaaaaaaataaaaataaat

SEQ ID NO: 262718 - DNA, 447 bp, Homo sapiens
ctcacagctgaggcaaagatcaatttatgtgtattttatttttatttatttatttatttatttgaaatggtctcactatattgctcaggttggggtgcagtggtacggtctcagctcaccgcaacctctgcctcctgggctgaagccatcttctgattttagccttccgagtagctggaaggtgcatgccaccatgcccagctaatttttgtagtttttgttgaggtgggaggattgcttgaggccaggagttcaagatcagcctagacaacatagcgagaccctatctctaaaaataataatagtaattattattatttaaaaaaccaagctgggcacagtgtgtgtgcctgcagtctcagctactcagaaggctgaggcaggaggatcgcttgaacccaggagtttgaattcagcctgggcgacatagtgagaccttgtctctat

SEQ ID NO: 262719 - DNA, 426 bp, Homo sapiens
catttccttcatttgggcaaataatacattaacttggtaatctaagacaaattcttaaaaatcaataagctaatcaaaataataaatatacatgtttaaaaatcaaatgacattaaaagccttgtaatgggctgggtgtggtgcctcacacctgtcatcccagcactttgggaggccgaggcaggtggatcacttgagggcaggagttcaagccagtctggccaacacagtaaaaccccatctctactaaaagtacaaaaattagctgggtgtggtggctcattcctgtagtcctagttactcaggaggctgagccaggagaattatttgaacatgggaggcggaggttttagtgagctgagatcacaccactgcactccagcctaggcaacagagcagagcaagactccatctcaaaaaaaaaaa

SEQ ID NO: 262720 - DNA, 484 bp, Homo sapiens
gagaggtcaaagagatcagaagtgtgagaaagcctcattggctcattggctttgcagatgaagggggttaccagccagggaatgtgggtgacttcagaagctggaccctggtcaacagccagcacggacatgaggacctcagtcttacagccatgtggaactgaaatctaccaaccacctgaatgaggctggaagtggattctcccccggagcctccagatcagagcccagcctggctgacattgatttcagccttgtgagattcagagcagagcctctgagcttacctggacttctgacctatggagctgtgagatcataagggagtgttcttttaagctgccaaattttggggaatctgttatagcatcagtagaaagcaaacacatgtgggaagccagctgtcaagttatgagcatacaaaggaaattggggaagtgataacgtcaagcattcatcatgataaggcttatgttattgaata

SEQ ID NO: 262721 - DNA, 1632 bp, Homo sapiens
atgggggactggaacttattgggtggcatcctagaggaagttcactcccactcaaccatagtggggaaaatctggctgaccatcctcttcatcttccgaatgctggtacttcgtgtggctgctgaggatgtctgggatgatgaacagtcagcatttgcctgcaacacccggcagccaggttgcaacaatatctgttatgatgatgcattccctatctctttgatcaggttctgggttttacagatcatctttgtgtcttctccttctttggtctatatgggccatgcactttataggctcagggcctttgagaaagacaggcagaggaaaaagtcacaccttagagcccagatggagaatccagatcttgacttggaggagcagcaaagaatagatagggaactgaggaggttagaggagcagaagaggatccataaagtccctctgaaaggatgtctgctgcgtacttatgtcttacacatcttgaccagatctgtgctggaagtaggattcatgataggccaatatattctctatgggtttcaaatgcaccccctttacaaatgcactcaacctccttgccccaatgcggtggattgctttgtatccaggcccactgagaagacaattttcatgctttttatgcacagcattgcagccatttccttgttactcaatatactggaaatatttcatctaggcatcagaaaaattatgaggacactttataagaaatccagcagtgagggcattgaggatgaaacaggccctccattccatttgaagaaatattctgtggcccagcagtgtatgatttgctcttcattgcctgaaagaatctctccacttcaagctaacaatcaacagcaagtcattcgagttaatgtgccaaagtctaaaaccatgtggcaaatcccacagccaaggcaacttgaagtagacccttccaatgggaaaaaggactggtctgagaaggatcagcatagcggacagctccatgttcacagcccgtgtccctgggctggcagtgctggaaatcagcacctgggacagcaatcagaccattcctcatttggcctgcagaatacaatgtctcagtcctggctaggtacaactacggctcctagaaactgtccatcctttgcagtaggaacctgggagcagtcccaggacccagaaccctcaggtgagcctctcacagatcttcatagtcactgcagagacagtgaaggcagcatgagagagagtggggtctggatagacagatctcgcccaggcagtcgcaaggccagctttctgtccagattgttgtctgaaaagcgacatctgcacagtgactcaggaagctctggttctcggaatagctcctgcttggattttcctcactgggaaaacagcccctcacctctgccttcagtcactgggcacagaacatcaatggtaagacaggcagccctaccgatcatggaactatcacaagagctgttccattctggatgctttctttttcctttctttcttcctggggtgtgtatgtatgtttgtgttgacagagaggcagatggagggggagattatttatggagagataaaattattcattcgatacattcagttaaattcaattcataa

SEQ ID NO: 262722 - DNA, 205 bp, Homo sapiens
ttaaaacaaagacagcaataagactaaaagtacttcagggcacatgagagcaaatttcaatcaatacttataggagagggaagttaattttgcctgaagagaagatctggcctgcattatgcattaattagtattagctaaaaactatgtggacctagcccttatcattaaaataaaacactcaagggtttacaaactattgaaa

SEQ ID NO: 262723 - DNA, 430 bp, Homo sapiens
agtaaataactctccaaagtctcagggtaattctttgtgttggactttttcttttttcttaagccttctcaaacctatcaggtttaagattctagttagtgatatttcctacttgcgatagctgagaaaatttgaggtgcaagacttgaccaaccttctcttgagtgtgttcgaggatgggagacttgaatgcatgtgtcaaaagatgtccatggagaagcaggtaataaagatgcaagaaaaacgagttgctagatctccaaacagggagagagggctgagatctagttttggttggtaaaggaatatagtacttctctagcattaaagaaaggataaactacatggacatctagaggaaacttcaagtgaagaagtgatccatgttggatttttgtctttgtttgtttaattaaataataatactgtt

SEQ ID NO: 262724 - DNA, 891 bp, Homo sapiens
cgttgcccggggatgggtccctgagacttggcgaagtaggagccctgtgtgatcgtgcgtcagagtcggggctgagaccagtcctggccagggcagttaccaggacggtctccggaggccgggatgcgcggaggctccaccagcaggaagaaacgccaggaggaagaaacctgagacagatcgccggggacgcagcgcgggatcccagcctcaggcttgcgcggacggtgtgcggctacccaaggtgcgaaaaggaaagaaggccaaagggaagaaggtggtgccgacccttgctgtcttgaaaaagcaggagaccgtgaaagtggtgaatcttccgtttgagaaatttggcactggacaggacattttggcattggacagaacatccagcccaaaaggcacctcacttgctttgtcaaatggccccattatactaggttgcaacagcagagagccatcctctataagcagctagaagtgccttctgtgattaatcagttcaccagggccttggaccaccaaacagctgctcagtggggtaagctggctggcaagtacagaccacagacaaagcaagagaagcagcagagactgttggcctgggctgagaagaaagcaaaggagacatccccactaagagatcacctgtccttttaacgggggttaactctgtcaccaccttagtgaagaaaaagaaggctcagctggtggtgactgcacaggacatagatcccattgagttggttgtcttcctgcctgccctgtattgtaaactgagcgttccttactgcattgtctaatggaaggcaagcttgagacatctaggattaaaaaaacaaacaaacgaacaaacaaacaacaactctttaaaatattcttttaaaacttcta

SEQ ID NO: 262725 - DNA, 465 bp, Homo sapiens
ctgcagccagccggcatctccacgcaggccttagcgtgtgaaggtgaggggaccttcacctctaccaaggcatccaactcctgggctttttatgcagctctgaaagttgggactgttccctttttttttaagttgctttaaaatgtcaccactacaggggatttttagagtgacaaaactatttgtatgatactctagggctggatatttttctttacattttctttacatttgtccaaacccatagaatattcaacaccaagagtcaaccctgatgcagactgtggactttagttaataataatgtatccattttggcttatgggttgtaacaaacataacacgccaatgcaagacgagaataataggggcacggggaggattagaggggaactctatttctgctcagtttttctgtaaatgtgaaactactctaaaaaataaagtctagtaatttaaaaaaaa

SEQ ID NO: 262726 - DNA, 560 bp, Homo sapiens
gtgaacctggactctgaagaatgtgccgtgtatgtaacaagtttttaataattcaactaagctattttataatgaagtgaatgtcacagaagatggaaatcaataaaattcattaactagggccccttcatggataatgtttggataagaattaatagcactggcttcttgatttcccaatatgaccaccagttgctatgtagcgctaaccaaacgactttacctctcataatctcgtatccaactccaaagtttactgtgatgattaagataatatttatatgacccacctatataaaaatttctcaatgaagatagcaccctccatattcactgcctacttctgttttaatgccagaaagagttttgagctatgaaataactcatgtctacctaactgtgctgcactgaaagcagaacacttgtgactcaactgaagagttaggcttaagagctgaactagcacatgttcagagaaggagataatttataatgatggataaagaataataatacttgctggatatggtggctcacgcctgtaatcctagcactttggg

SEQ ID NO: 262727 - DNA, 232 bp, Homo sapiens
catagagataggattaattttatcctccaaagtaatagtggaggagaacaaatgatagcatgtcaattttaacacaaaatttccaaatatattttgacttctgcttttaatactcttccagatcatgctttttgcctaatttttttttttttttgagacagagctagactccgtctcaaaaaaaagaatcgcttgaacccgggaggctgaggctgcagtgagccgaaattgc

SEQ ID NO: 262728 - DNA, 439 bp, Homo sapiens
gactgaagatagaagtctgaggaatggattattttggacgtggtaagagctaactgtggctcgaactaaatttggtctcattaacataaaaagaataaggatattgggaagcaatgcattgttaggccttagcagaggatcgaatataggatatgtgcacctatagtaggacctttgtgttagagatgaagtaataatcatttcttactaacatcaagatactgacataaaaaggatgcatctctgtattgttttgaattggggattttttgttttgttttgtttttagaggcgggatatcactctgtcacccaggctggagtgcagtggtgtgataatagctcactgcagcctcgaactcctggactcaggcagtcctcctgcctcagcctcctggaacattgggattatggtgtttgaattgtagcgtctctagtag

SEQ ID NO: 262729 - DNA, 317 bp, Homo sapiens
atgacatttccaaaaaatttttttcctttcaaaacccactcctctccatcctactaaatggcatcgccattcattcagttgctaaggcctttaaaaaatcttggaatctggccaggtgcagtggctgacgcctgtaatcccagcactttgggaggccgaggcaggtggatcacgaggtcaggagatcgagaccatcctggctaacacggtgaaaccctgtccctactacaaatacaaaaaaattagcagggtgtggtggcgggcgcctgtagtcccagctactcgggaggctgaggcaggagaatggtgtgaaccca

SEQ ID NO: 262730 - DNA, 907 bp, Homo sapiens
ggggatggtcctgcctctctcggtgaagttactcactcggaacgggtgagctttgtgatacgtgctctgcgttcagtagcgctgttacagtcgtaagtaaaagcagtaacgtcagcgccgacccagcgcagccctctccagaccgggtgcggagcccgtcacgtctgccccgccggcgaggagcagagcccggcaagaaccctcctccagaggggccccgaccagggctgtgcctccgggagcaggtgctgcttacacagagggacgccaggacgggcagccccacacctccagtgacctcccgtcccccagagctgaagacatggcctgactaagcggcgaccacatcgacgcaccagttttttcttttttgaaacagggtctccctttgtcgcccaggctgcagtgcagtagcgcgatctcggctcactgcagcctctacctccccggcacaagcgatcctccagcctcagcctcccgagtagctgggactacaggcgccaccatgcccggctaccttttgtattttttgtagagatggcgccttgccaagttccccaggcattaacccggaaacaacctggcgggtcagggagagcctcttctgctcagaggtcattgtgcccagacttgagccctggctgtgaagtccctgaggcccctcactccaggacgggaagcaccaaagatgtgatgtttcctcctcggtttctgagactgcctggaagcggggggtggatagtggtgagcagccgtctcctcctttcctgagaacataaatcagaaacgctttctgaggccgggcacggtgggtcatgcctgtaatcccagcactttgggaggctgaggtgggtggatcacctgaggtcaggaccagcttggccaacatcgtgataaccccctctcc

SEQ ID NO: 262731 - DNA, 424 bp, Homo sapiens
gagagagacaacgatacacagagagagaaagacagaaagagagagagagacagataaagagacagacggagagagacagataaagagacagacggagaaagacagagatggacagagacagagagaaacagaaagagagagaaacagacaggaagggagagagacaggcagagagagagagacaaacagacaggcagacagacaggcagagaaagagagtaagacagaaggcagacacacacacacacacacacacatacacacacacacacacacccccacagagagagagagacagagagagagacagagacagacagagagacagagagaaagagacagagagagaaagacagacagagagaaacagacagaaagagagacacagacagagacagagaaacagccgacaggggggagagag

SEQ ID NO: 262732 - DNA, 444 bp, Homo sapiens
tggcataaaatgccataaagtcagaacaaagagtgagcccagggccttgatgggtctgctgcttcctgccgcgcagagaatacaagcgattgtttcaaagccagtggtgaggcaagtggccaattagcacggccttcacccccacagcctgtaaatgtgattcggaccatcagaatgggattctgctattcagatcaattgctcaaaggaagcgagtctgttctcgctgccaaatttagaagcccgagacagcaaaggtgacccaggttatggctgcagctctcgtcaggatgaggctgagccctgccaatgcttagcactcacccagccctcagcacctctgcccattttcctgcccctttaaagtggtgtaagggattcctagaacgttgctgcgactaggaggttatacatctgttcacaatcgtattggaaaaaacaaaa

SEQ ID NO: 262733 - DNA, 433 bp, Homo sapiens
attttatgtacatgttggtacaagcattttaggaaacaatatgacattatctggtaaagttgaagatgtgcatgccctacaatctttcaaatccactcttatttacatgcattgtgaggagccatgtctttgagtgtttataacatcaatatataacccatattgggaacaacccaaatgtttattcacaagacagttgtaatatatttattcaacaactaaaatttgtactatattcaacaactagaatacagtagcaaaaatgaatgcttactgagaatcttggggggtaatgaagtggactatatcttgattaagtagtgggtatatatatatgtaaatgcatatatgttaaaaatcatcaaagtatataaaatgggtgcatttattctgtgtaaattatacctcaataaagtcaactttaaaaataaat

SEQ ID NO: 262734 - DNA, 385 bp, Homo sapiens
ctgggattacaggagtgagccactgcatccagccccacatctggaattctttgcctcttgatgactctaggatccctgtaactgagggcagaggcaatggatgttaaaatgtgcatattctttggtccagcaaccccatttctaggcatttattctccagaaatataacaccaatgcataaagatatatgaacaaaaaagtcatgaagcagggtttgcaaccgcaaacatctggacgccacttcaatgtccattacaaggagattagttaaatatatcaaaccatggaatactatacagcaatgacaaagaaggtctttagtcttgatggaaaagggggtttgaggcatattgttaagtgaataaagcgggctgcacacaacaaa

SEQ ID NO: 262735 - DNA, 401 bp, Homo sapiens
gaaaagaggatctctgccctcaggaagctctcagccgaggggcaggcgagctgcctctcaaagctcgccagctccccttgcctagaagtccagggctgtctgtgaacaaagcttaggacctcttgggtgtcctacccactttcctgaacatggcctcccctgaccctcacaggccacccccttaacttcatcactccctctgggctcctgccttctcaagagcctttccaaacaccccatgggaagccagagagccagcagatcccaggatccttccagaaagtgagctccatgaacgtctggcctctctcaggaatgcattctccaggtctggcctttcccctgccagactgcaacatccctgaccaggagagatttagaccactccatcccggggcctg

SEQ ID NO: 262736 - DNA, 181 bp, Homo sapiens
gctgaggaatacagggcaaagggctcaagacctttagtagcaagcaatgaaaagtcacttccctttcttgtggggtggggaagatattacactgaaattgtcctctggccatcttgacctacttatttgagtatatgaccagttacagaaatagctcagtaccaggagacagataagcctt

SEQ ID NO: 262737 - DNA, 136 bp, Homo sapiens
ggatatgggggaaaataatctataggagccctttcagttctccagccctgctccatgcagccaaatctccagccccaattatcacacttatgccaagcctccctcccaagcctcccacaccagcagcctccctcac

SEQ ID NO: 262738 - DNA, 168 bp, Homo sapiens
atggggagagaggaggacctactttcaaatggaactgtgacacatatgttctgcaggaataccggcccaccagaaccctcaaccccatggcccctctctggctgccccatagaagcttgtacacaatacagcctctgtttgccagtttgagtgctttgctccatctga

SEQ ID NO: 262739 - DNA, 641 bp, Homo sapiens
tatatatatacatacatatatatatatgtatatatatatatacatacatatatatatgtatatatatatatacatatatacatacacacacacaaaaattagcaaggtgtgatggcacacacctgtagtcccagctactcaggaggctgaggttgaaggattgagcctgggaggtcaaggctgcagtgagccatgagtgtgccactgcactccagcctgggccacagagcaagaccctgtctcaaaaaagtaaaattaaacatttaaaaaagcagaaatgatagccaaaacatttaacaactgatacagggtgggcacataaaccaatcagaatggaagatggaaccacttaaaacaaaggctggtcattaaaacctctcattcagccaatatatcaaatgaatatcaagactgctaaagagttacatttgcaaagatgtatctttaaaaatcatcatcctggagcataaattaacttgaaagagtaaggattccatgaagacaaacaaaaatagtccaatacttgacagtcttaattatatacatcattatataaagacaacagatagaggagttgtatgtgaaatacatcatatgacaaaagctaaatctaaatctaaaactattttgtaacattacta

SEQ ID NO: 262740 - DNA, 681 bp, Homo sapiens
gagatatatcttttagtcaccactttctgtctgtaaaaatttcctaagtatatagaattgctgttgtatattttgtaacaggaccctaaatcgtgaatcagaaaataattgttccttattttccaagatatctgtagatcacatattcacaggtagacaatgaatgtattcatatagcacacatatatttagagaaatgtttctttttagttttcataacaagaatgcagatataacaagtcgtatcttttccttatttaagatacccgaatctcacttatattgagcagtacaaatcagcactaacccacaatcagaacaaggcatgagcctaaaagaaataagagctgtaggtaagaaatgatttcttctgattttattacataatttacattacaatactgaaggaaatagctaaggaaataaaaataatctacaaaggtactatattactattattttcattctcatttctatacagtttgtctatatgtacatattttacacaaaataaacatttttcttgttgctacattattcttcacaatgatcacaatgattatcctgttaagattatgaatcctaatttgccaaaccgttgccctatttgagggtatttactttttcaccattctaagtcctaatgtaataaacactttcatttatgccactttttccctc

SEQ ID NO: 262741 - DNA, 428 bp, Homo sapiens
ccacagtggaactcagctgctctgactctttcctggtctgcttgttctgaaggatacaagcagaggcacaagcctcatgcattttccaagccctgcaagccaccccatgctccaaagtagagaccaaagttatatacactttcacaaaactggcagaaataagccagaactgcatccaaaatgattcttcatcttcagtgctgtttcccaaggtttcaacctccccagcctaaccaggatacttgaaacttttcttggagaaacagtcactatgaatgtttccccaggtgattttaaaatgctttcaatgcacagtttcttatttcactaaataaaatataaaattgcctggaaacgattcaaccattttgtaagttgaattccaaaaggagaactgtaatgttctccttatatatttcatagctctc

SEQ ID NO: 262742 - DNA, 623 bp, Homo sapiens
gagagagagagagaactagtctcgagttttttttttttgtacactctattctgccattcagtaggtgcttaggaaatgtttgttcgatgaatgaatgaatgtactaaagattgagaaactgcttggaagcatggcaccggggaaagaacactggaccaaaagccagaagacctgcactctaggcctggttatgtcatttatttatgtgacttagagaaaatcacttgacctttctgactctcagctttctagtctgtaaaggagggataataatatctgccctccttatttcaaaagtccacagtaagtgtcagatgaaaatcacttggaaatattttgtatagctctaagcaggctgtacagatgtaagaataatttatgtttgtgtttactctcatcccttgaaatgcctataaaaataaatcacttattacacgaatgacacagggagaaggaagaacgacagaatgccagtctaaggagatcaaccagtgggatatgggctcctggaatgactgcagttaactcagggaaaagagctaacaaatgccctggttatcccatatccattaccacatgcatttcccagccaaatgggaagataaaaatctgttctcgagtga

SEQ ID NO: 262743 - DNA, 505 bp, Homo sapiens
ggggcctctaattacattttgacatctacattctgggtagattcatataattttaagaacatttaaaaatactcaagtccccagaagcaaaaaatttaggaaactctaaaacaacaaggaagatgcacaacacacatacataaccagagagcagcaaagaatcaaaggtgtctaacagctattttgaatttctgacccttgttattctgtcaaattgatatttggattaaaaatgagggatgttgtttacttaataggcaatactcacaaaattgacctcttttggtccggaattaaagtattccaaggccagaatacaaaaaaagaatctactccagaatgctactattaaattacacaaagaaataacatagcttatcaagtacgaatttatagccaaaaaacccttaacgggaagaataaatattaaaaaggaaacaaaaagtaataaaattaactatccaagtgattggattatcagtaaaactatttttaaagagccatg

SEQ ID NO: 262744 - DNA, 449 bp, Homo sapiens
tgagatgacttgcccaaggtcccacagccagtaatttgaatgcaggcagtcaaaccaaggaggaagcagggagcagctgtgcctggatgggcgagggtggaggactgcacaggtcagggagctcgttctggctcctgccaggggagtcggccatgcagtgtgtgaaaggtctcctggttcctgggagtgttggctgtgatgacatcatcctagaagtcactgactggattggcaatggggctgatgctgagtgcctggcacgctatgtgctgggcactgggctacacaacggacactgaatactttccatagacaaccctgcacgatgcatgaccttgggcaagttacttgacctttgtgggcctcagttgccttgtcagtaaattggggataataataggactcacttcccaggaataaatgactttctccaagtaaagcaaaaaaaa

SEQ ID NO: 262745 - DNA, 515 bp, Homo sapiens
tttccaaaacaaatacgcatcaggaagacagctcgagataaactctgaactaggattcaggcatctggatgaatgcatcttcttcagccagttccaccattaactcgatgacgatgcgcaggtgcttgaggcgagtcagtgcgtccttcttggtgtctagcaccttctgggtggacttcttcacgtccccgtgcggcttcttggagaacatcctgccgctgccactgccactgccactgccactgccacagccggctcccagcggcagaaagtggagggagtggacggggaggagactagccagagaggctcattagctccccagccttgcgggccagggcagagccgactcctccccgatccaggccagggccgccacctccacccgcctcgcgccgcggctccaaggcaccttcggccccagctccaatatggcggatccctctcccggccctgcacggagcgaggtagacccgggctggccgcctgccgccgccgctcgtctccagcggccg

SEQ ID NO: 262746 - DNA, 526 bp, Homo sapiens
gaagaacaatctaggggccattttaaaattaggtggatttttttttaacttacagcagtggtaatatttgatcaacagttagaattttccagcttctcttcctttttgaatattttgagatggacttcactattcagataacaggttaagatcctcattgtcatttctctttccttggctgtcttaaagaaaacaatcatctcaggtagaggagtattagcgggagggaggaatgatccttggggaaaaatttataggtgttttgttttgttttgaattaggtaaatccattaactgcctgcactccgcagccctcactccccaacactttccctgagtttatttaagtggttgcccatagcaaccacctacactttaagtagctgagctgagtattgcggggagacagcttggcaagcctctgtctagcttccatgatcattcactgtgccccggaggtaacaatgtaaaattcaaatgataattttaaaatattaacaatgtttttgtgtttcctgtatttaaa

SEQ ID NO: 262747 - DNA, 376 bp, Homo sapiens
ctgtgcactctctgagggcaggtgcttgttcacagctgtgatcctgcagctgatgcagcgcctggctcacagtaggtgctcggtaaatgttgaatggatgaaacatgaatgagcaagtcagagaaccagtgcctgtgcccatttgcccctgttgttcccttggcctggcacattcttctctaggctttggcacaagccacagctcacattcttcctttgagtatcactctgtgaagcttaggaggccaccagggctgtctttgggggctcagagatctctaggctcaggcaaggatgcccagtaaaaatagtttttgtagaaatgagctccagtactgagaccctgagagaggctctagacgtgagagacttgggc

SEQ ID NO: 262748 - DNA, 396 bp, Homo sapiens
ggaagtagtgagacagtggaaggaggggagagagggggagaaagggaaaaaaaagtgcacactctatctgcagcgtgcatccagtgtaatgagaaaatatggacaggcacaatttcacaagttgtaaattctggtagccttcagttgtaaattctggtggaggctgttttactcggctatctgataatgtgtgaaaatatttgtccctttgcttcacaggcatgggcattttttttaaatcatagaccctctaaaaacaaaatgagaatttgtgattgaaatgaaatggtaactgatttttttttaaaaagattctccctaaatcagacctagtgtttgacagaacagtagaatgactatagtttacagtaatctattgtatgttttgaaatagct

SEQ ID NO: 262749 - DNA, 396 bp, Homo sapiens
cagactggagtgcaatggcacaatcacagctcactgcagcctcaaactcccgagttcaagtgatcctctgacttcagcctcccgagtaggtgggtctcaaggtgtagagactgggtcttgttatgttgcccaggctggttttgaactcctggcatcaagcaatcctcccacctcggcttcccaaagcaatcctttaactctaaaaccacatttcccttctctgaaagtcttccttgaccctcctttatgctgctctccattaagaccttcatacaaatggctgggtgcagtggttcacacctgtaatcccagcactttgggaggccaaggcgcgcggatcacgaggtcaggagatcgagaccatcctggctaacacagtgaaacaccatctctact

SEQ ID NO: 262750 - DNA, 320 bp, Homo sapiens
gggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaggggaggcggaggttgcagtgagccaagactgcgccactgcactccagcctgggcaacagagcaagactccatcttgcaaaaaataaataaataaataaaaatatg

SEQ ID NO: 262751 - DNA, 270 bp, Homo sapiens
gtatttttagtagagatggggttttgccattttggccaggctggtcttgaactcctgacctcaggtgatacgcccgccttggccccccaaagtgctgggattacaggcgtgcgccactgcgcccggctgcattccttaactcatgctccctgcttccatcttcaagccatcttcaaaccaccctaatctctgcttccatccccacccctcctccacggaccctcctgcctgcctcttccccatgcaaggactgttgtgatgacattgggc

SEQ ID NO: 262752 - DNA, 549 bp, Homo sapiens
agatgctattgttttatgtttcctcttcagccactggctgtgattttaattgtgctggaggatcttcattagtattaacacatggggagatttcacaaagctgcttcattaggaaaaaaaaaaagcttggcagactcggtctttttgcatgcactgagaatgtcagccttacctcggtcatttgtaacataataagtgcaagtacaatgattgcaatgcaggagcactgggggaagggcagaaatactgcctgtctaatagggatatctgaaaagaaggctgctcattacagagtaaaatgtatgctaaaaattagtgaagatgatgtctcaggagactgatgctaaataaattaatgtgctgatatgtttttaattattatttttgtagtagtttatttcattctcaggattcacattgagcagcaaagctgtgctagcacttattgattttttttccctgccacattcccggaatacagattttaatcatttcactacaccacactcagtaatttcattaaaaactggaatcttccatccccagaaa

SEQ ID NO: 262753 - DNA, 367 bp, Homo sapiens
aatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacagga

SEQ ID NO: 262754 - DNA, 402 bp, Homo sapiens
taggaactcaacatttcagaatcgtccctgctgggctttgaccatctgatggaattttgagacagcatgatgcgactagttctagggttaaaaagacgcactttaatgtcacctgaacataacacttcagaagaaggtgataaacttttacacccacccaggctgaagctggaggggagtggagtttctgaagctgtggcacatggtgcacaggtccagcaagttctcgggcaccagcagtgcccacggtggaagacaggcaggacagacgagggtggaggaaggagcccagggcagagccaggacaaagcttgctggacagtgtcactcatggagtgcccctagcttcaccccatctgtgacaaatattttcaagatttccattaaaaaaatttactgaaa

SEQ ID NO: 262755 - DNA, 400 bp, Homo sapiens
tgagacacagtctcaccactctgtcacccaggctggcaggctggagtgcagtggcataaactcagctcactgcagcctctgcctctcaggttcaagcaattcacctggctcagtctccccaatagctgggattacaggcgcgtgctaccacacctggctaatttgtatttttggtagagatggggtttcgccatgttggtcaggctggtcttgaactcttgatctcaagtgagccacccgccaagcttcccaaagtgctgggattacaggcgtgagccaccatgcctggccagaagtcatttaaattctgcgtcttagtttcttcctctgtgagatggagagactaacaggattgctctcccggggttgttgggaggattccatgagatgaagctgggga

SEQ ID NO: 262756 - DNA, 400 bp, Homo sapiens
actggatccctaactattaccatatacaaaaactaactcaagataaagatttaaattgtagacccagaactctaaaaccactaaaagaaaatacaggggaaacacttcaggacattagtctaggcaaagattttatggctaaggcctccaaagcacagacaacaaatcaaaaaacagacaaatgggactgttttaaactaacaatcttctgcacagcaaaggaaataatcaacagagtgaagaggcaacctgccgaatgggagaaaatatttggaaagtattcatttaacaaggaaataatatctagaatatacaagaaactcaacaaaactcaacagtaaaaaaaaaaaaatctccctactaaaaaaagtgggtaaaggacataaatagacatttttca

SEQ ID NO: 262757 - DNA, 301 bp, Homo sapiens
taatagtgacacaacctatcaaaacctctgggatatagcaatggttgtgctaagaggaaagttcataggattaaatgcctacatcggaagtctgaaagagcacaaacatggacctggagaaacaagaacaatccaaacccaaacccagcagaagaaaagaaataatgaagatcagagcagaactaaatgaaattgaaacaaacaacaacaacaacaaaaatacaaaagataaatgaaacgatatgctggttctttgaaaagataaaaaaaaaaagaagatagaccattagtgagattaacc

SEQ ID NO: 262758 - DNA, 799 bp, Homo sapiens
cctttatcagtgactttgtcatgttccctatctccatgttcttgtttaggtgatactattttctgaggtggtcggaagaaaatgtactcggtgtagctgctccagatcttgtcgtcgcggtactggttgacgaaggcggcggtgcccgaggagttacacgccaccatgtggaagccggcctcggacaggcgatcaaaggcctgctccaagtaggtgaacttgaggtagaagcgggacgtgtacttctccggctgccggtcggggtcgcggctctcgttgagcgtgtccccgaagacctccttggccagcgcgatgcgcccgcacaccatgatgcgcgccacacgccggaatttggcgtcggcctggttgtcgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctccggcagcgcgagttgcttgtcccgcagataatccagcacgtacctgaaaaggaagccgtcccggtcgatgaagaagcgcgcccggctgtccctgggcagctcgccccggcgccgggcgccgccacggg

SEQ ID NO: 262759 - DNA, 296 bp, Homo sapiens
cactagatggggacgtgcgattgttacagggctgaaggcctatttattttttatttggccgctagagggcacgcctgcactgcacttaaagttgactacttttaaggaaagacaaaagaattcttggatttctccattttcctcatcacctgtgcttatcagagaattccaggggcaagctaccctttccaattcatcactaatttataaacaaaattctaaggagtaaggaatgcttcttacttcctataacatatgtaagaatgaacgctcaaaataaaagtaatttatttaaa

SEQ ID NO: 262760 - DNA, 521 bp, Homo sapiens
gacaggatcttgctttgttgcctaggctagagtgtaatggcacaaacatttcatttcagcctcaacctccagggctcaagcaatcctcttgtctcagcctcctaagtagctgggactacaggcatgcaccaccacactcagctaattgttttatttgttgtagagatgggagtctcaccatgttgcccaggttggtcttgaactcctggcctcaagtggtccccctacctcagcctcccaaagtgttgggattacaaatgtgaggcactgcacccaaccagaaaagtttttgaacctctccatacctctgtttcttcatttgtaactgagaggtactcatgcttcatagtctcattgtgaggcttaagtgagatcatgcatgtaagcacttagcattttgcctggcacataggaagccctaattgttagaaccaagagattgaaaggagagcagggttataatctttttttttcatcaaaataactggtttttattacattaagttatacctgtatatgta

SEQ ID NO: 262761 - DNA, 348 bp, Homo sapiens
gacaggatcttgctttgttgcctaggctagagtgtaatggcacaaacatttcatttcagcctcaacctccagggctcaagcaatcctcttgtctcagcctcctaagtagctgggactacaggcatgcaccaccacactcagctaattgttttatttgttgtagagatgggagtctcaccatgttgcccaggagttcgagaccagcctggctaacatggtgaaaccctgtctctactaaaaatacaaaaattagctgggtgtggtggttgcgcacctgtatccccagctactcgggaggctgaggcaggagaatcgcctgaacccaggaggtggaggttgcagtaagct

SEQ ID NO: 262762 - DNA, 221 bp, Homo sapiens
tggccatagcagtcatgagttaggctgtaaaacataagttaaacgcagagtgtcctatattgaattagaccctaaaatgtgctatattttcgggtctaattcaagtaacaagtgctataatcacctttccataggctaacagaatgaaggctgtgtcaaatctatgcttttatttctcccaaatgcgttccagtcctggtactcaataaatagtcatcaca

SEQ ID NO: 262763 - DNA, 527 bp, Homo sapiens
gtagagataggatttcaccatgttgcccaggctggtctcgaactcctgggctcaagcgatctgcccacctaggcctcccaaagtactgggattacaggcgtgaaccactgcccggctgagaaggaggttcttccgcgagagaaggctatgcagaggggaggatctcaggcctgaagggtctagaagcccactggaaggtcttccagacacttgggacatctagctcctgaagagtagaaagaggagctgctgccgaagaggtaagacagagagaggggcacaggatgtggagtccgcccctctgtcctcagggagtttctttggagagagaagagaatgaggctgggctcagaggaagttcctcccactccgtggagctcaaactagtccagtggtggcagctgccctggctggaataaagcatcgacccacagtggcctcacatctctgaggcctttgcaggttaagagtctcctgccatgataccccaccacagtggaacccgttgttgggccagcgtgttctca

SEQ ID NO: 262764 - DNA, 563 bp, Homo sapiens
cagcatgaagtttttaaaaatgtaaatcagtgttacttccctgcttaaaacactcgaagaacttcttattattcttaggatcttagataaactttttactattattcttttagtgatttgaccctcatctgcctctctgatcttattttgtccctcccttctccttcttctccatgctgtggactcactgacctttcagttcagaagaatatggtgtctattctgcctgttcttttctaaagatgctgtgctctgccttttttgttgatctctttttctctatatagctggtgtctgtatttctggtttctgttcagatgatttctcctatgagtaactttcctttctgtctctggtacatgtatttttctttatgtcattttattactgtttgaaatttgattagcttctgtttccccctccagaatgtgtaagctatttgagagtgatgattttgtctgtttactactgtaaactcagaatctagaatagggccttgctcatggttggcaggcacttatcgattattgttgtatgaataaacaaataagtgtttccatctg

SEQ ID NO: 262765 - DNA, 376 bp, Homo sapiens
tccatcagtctcagccaatgtgtaggaagaggcagatgaataatattgaaccaccattagcatggcacttctttacttcacttctttactcctaatacctagaacaatgtctagcacattgtatgttctcaataaatatttggtgggtggttagagggatgaatgcatgaaaggatgaaaggaacacatgaaaggaaggaacatcaaaggagctgagcttgagtcttccctttgccctttattacctgagtgactttaggcaagtcagttgatcttcactgaacctttcgtcttatttagaaagttaggggataaaataggtcctattctgataaaataggtttgttctgagaatcagatgagagaataaacatat

SEQ ID NO: 262766 - DNA, 376 bp, Homo sapiens
ctgttgacatcttgatgagactgtattagacttctgacctacagaactgtaagtcaactggggagctcagtgagattctcctgctatactctcatcagttttaagagaggcccttatctgcattggtaagtacagctaaactccacggatccagactgaagcaatttacctggaaactacttcctttccttcaaaagtttgcctaggccattcggatttggaagatttctgagcaagatggctgagtgctgaatttaacagccaagatgattctccaatctctgtgcttatgtctgcacacatcagagactctcctttacctagccctgtttattcctgaacacaaagtaattaatacttcaaagtgttaggtatg

SEQ ID NO: 262767 - DNA, 301 bp, Homo sapiens
tgtatttctgcaggcttatttttagagtaaattcctagaagtgggatttctggaacaaaagagatggagtctatctatgtcatctaggctggtctcaagctcctaagctcaagcaatccctcccgtctcagtcctccctgccctgtctcttaccagagacttcaggataaactccagggattgagtgctggtgtcaaataaacttcaacatgggaaacatcggaagaatacattctgcacttcttccagacttggaaagaactggggccaattaaaagtgaacttttaagagaaatgaaca

SEQ ID NO: 262768 - DNA, 464 bp, Homo sapiens
ggacaacagtcacattggattagggcccacccggatgacaagctttaaccttagcttgttaaagactgtatccccaaatatcatcacattctgaagtactggggtttaggacttcaacaagggaatttggtgaaatacaattcagcttataacagcctccacatcagtagaagtacggcttccatcaagagttttaaaataacagaagttcagatttgtatacatgggtatataaatgaaagggatcaacctggaggacattattaagtgaaataagccaggcacagaaagacaaatattgcacgatctcagtcataagtggaatcttaaaaagatgccttaatagaaatagagagtagaatagtggttatcagagcctggagaggggaggggtaaggggaaacaaaagaggttgatcaatagatacagagttgtagttaggaaggaagaataaattccagtgt

SEQ ID NO: 262769 - DNA, 596 bp, Homo sapiens
gcccatgactttgtgctgttgttgcctgctgcctttggaagggagataattgtaaaataattcaaataaaatttaaaagagaaaagtaaacagaacagtaaatggagcagataaggtatattctgtttggctcttgggagcacataatttaatcagtcatcaaattctgattgcataaataccgttcatgggtattccagccgtttggaagcaatgtctgcctgacaaatggctcattttcccaaatggtggcaattcttagccccaccctgcttcctctcgcgggccttagctgaaatgtgtcagaacgttacagctgtgacataaaagcctcaacatctgaacaacactgggctgtgttggaaattcagccttctctataaggctgttgcttgttactcacattggggtcacaaggtcacacaggtatggaatttttgcattaggaacaactgcaaaaaaaaaacaactctagtctattgtattataatcttaggctgggacaaactgagccagtctcactgagtgactgagccttaaatcagctgaagacttgattgtttcagtaactactgaaataaagcaaaaattttcca

SEQ ID NO: 262770 - DNA, 367 bp, Homo sapiens
aagtaattcaaatgtttctagcaagaagaaaagatacatatttaaggtgactgatagcccgattactcttatttgatcttcatgtattttatgaatgtattgttatcacagatacttccaaaatatgtatatccattatgaatgaatacataaataaatgactttggaattaagataatattggtcataggttttgatgggcctggttatccaggccaagtttatttattaagttgggatagaaatagtacctactatttttataaggattaaacaagttgctctaaagattaagtaatactatgtctattaaataattaatgcctacaactgaaataaaaaaaaatttgctttgcctttttttaaa

SEQ ID NO: 262771 - DNA, 653 bp, Homo sapiens
cactggttagatacatacatactggttttgcatttgtaagatccaaagtctttaaatttatgaaatgccaaaggataggactgtgcttaaaattttagaaatttaatccaatatttttcatgtgatagtaagtcaatgcaatagactacattgtttgaatttctatagcaactccaaaaattacaggcattcagggaaaaacagaatctgaggagacaaagcaatcattaaaccagactcaggtacgacactcagttcaaatgttaaaactgtatgaaataaaataacaatgattaatatggttaaaggggttgatggaaaagatataaaacgtttaagatcgaataggtaatttcagtgaagagattatgagaaagaatcaaagagaaatcctagaaatatacaaacatagtaacagaaataaaaaacgcttttgatgctatgatcagcagtcttcaaacagttaaggaaagaatacgtgggccaggcatggtggctcaggcctgtaatctcagcactttggaaggctgaggcaggtggatcacctgaggtcaggagtttgagaccagtctgaccaatatgggtggtcaaggctgcaatgagccatggctgcactgcactacagcctaggtgacagaccaagaccctgtctc

SEQ ID NO: 262772 - DNA, 330 bp, Homo sapiens
catagggcatgaagggttgcggatggctgggtgtcccaacctgttccctctttccctttgcaactgaagacttagagtttatgatgtgatatgccaataagagaatgacgtgggctgtggagatccaggtagagctaaatgaaggctacaaacacttctgtgatgtgtagaacccaccaggcccacctcacatctagcctcatgagaagatgccttctgaggggattcctgcatcctgcctacaatgcccccttctcaatttcttctcttctccattttgctagcgttgaccatttctaacttctcatggagatacttgtgccaggccca

SEQ ID NO: 262773 - DNA, 331 bp, Homo sapiens
gaaatgtgcatcgcttcttggtgggatgcagattgccttgcctatggctcagcttatacgttttcctaccatcctatctagtatcagtaaacgtggcctgctttcatttttttctccaggtaacactcgtgaagcagcaaaagaagatccacgttattccagaaattaatgccagcgaagtcaatcgtgtacatcaagttagcacaatttctttctgatggtcctgaaaatatagggggacttggagttaacacctgtgatgcagaaactaatctgccattcatttgatgtgccatgttggtcaaatatgttaagcccacacttcctgact

SEQ ID NO: 262774 - DNA, 375 bp, Homo sapiens
aggctgtgaggcagtctcatatattatagggcgataagtcaggatgctggaaccagctgcttggtgtcataaacctgtagtcagtcatatccaggctccaacactccttggctatgtgaagcttaacatctcgatgcctcagcttcctcatctcgaacaggaggatgctaataatacttagctcatagagttgataggatcacaacagtttcaaaacgtgtaaaacacttaaaacggcgaatggctcatagtaaattctctactaaaagttaattgtgtctgggcacagtggctcataatctcagtgcttcgggagatcaaggaaggaggactgcttgagacaagcctgggcaatataacaagaccccagttcta

SEQ ID NO: 262775 - DNA, 305 bp, Homo sapiens
aacatggcaaaaccccgtctctactaaaaatacacagattagctgggtgtggtggtgttcacccgcagtcccatagtcccggctactcgggaggctgaggtaggagaatgacttgaacctgggaggcagaggttgcagaaagccaaaatcgagccactgcactccagactgagcaacagagtgagactccaattaaaaaaaatctgaacagaccaatgagtaaagagatcgagtcagtgatttttccaacatctcgaatcaaagtccagaacttcatggcttcactactgaattttatcaaaaat

SEQ ID NO: 262776 - DNA, 341 bp, Homo sapiens
  misc_feature (77)..(77): n is a, c, g, or t
  misc_feature (329)..(330): n is a, c, g, or t
  misc_feature (334)..(334): n is a, c, g, or t
  misc_feature (336)..(338): n is a, c, g, or t
  misc_feature (341)..(341): n is a, c, g, or t
gcctgtaatcccagcactttgggaggccaaggcgggcggatcacgaggtcaggagatcgagaccatcctggctaacncggtgaaaccccgtctctactaaaaatacaaaaaattagccgggcgtggtgttgggcgcctgttgtcccagctactcggaaggctgaggcaggagaaagtcatgcatccgggaggcggagcttgcagtgagccgagatcgcaccactgcactctagcctgggcgacagagcaagactccatctcaaaaaaacacaacacttgggagaaaagtctaaacttgtcattcagaacctcacaaaaataatcatttnnaaancnnncan

SEQ ID NO: 262777 - DNA, 520 bp, Homo sapiens
ctaagtcaggctgaagaataacagctacatgtcatatagcaggacttgagagctaagtttggtgtgtccctatagtgctatataatttaaatagccaactaattgttgggatccctgttccaatactcctcaccattctctcataaatgtctgcatcccacctgccatctttaaacataatcttttgcatcctccccagaaacagctctcattatcttgcagtgaagctgtctggcatttgtagagatacttgtgattttcagtttgtgagcattttacacatatgtgttggtttacaggtgtcatgtttggattttaccataagcttcattgtattagtttgctagggcttgaaataacaatgtcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaa

SEQ ID NO: 262778 - DNA, 531 bp, Homo sapiens
aatgaatcctacaatgaaatggagttcccagtatggttacatctagtctcaattcatctgcctaatatttgagggatgattgcacaggaagggaaactgttgaataaagtcacgaggctgaccataaagagtctacaagctcgaaaagtgctacacctcactccctttccagtggttcagccactggaaaccaaatgcctacacctatatgttttggacctaatattttcatttagcaaatccgtaagaaaccttccatgtctgggcctaagacatcaagtacattcattttcagcaatcatcaaatcaatgagattcttccagaatacagcagagtgaacatatgcttttcattccaggatagctttatataatccctggcaacacaaaataccatatttggcccacagtaggggctcaataaataattcaatatatataatattaatcaggaaattagagcagactgtagactttctgggcctttgctctttgttagaatcaagatattaaaaagaattattactttat

SEQ ID NO: 262779 - DNA, 383 bp, Homo sapiens
ttttcattgtaacattttaaatgactgttaaggagttagagtgaccatccacagcacacatggaaaaatgctgcttagaagcatgggacattaataagtgaactgatatttatatcttagaatttgtttacttttttgagaatctcattagaaacctatgctgggatataaaattctttaggcagatttcactaagtagagccaattgtcctttgtttcttttgctgaacccagtattgcataaaactgccaatgcacaaccaagctgtaggctgatggaaaacaacatcagccaagagattcacctagaagccagctaacggagctgggttcccttttggtgtgaaggcatcagaagaccatcagctctagaaataaaactg

SEQ ID NO: 262780 - DNA, 490 bp, Homo sapiens
taaaatggaaatgtcttctttgtacaaaattgtagcagtgtaaacaggttgacaaaaaatgactagaagatacaaacaaaaaatttacagtttaaccttgagaatgattggcttgaatagcactcatcttcataggttcctttattttgtattgttaatcttaatagtttgattacagacctgttatgtacatatacttgctaaagtctgtgttaaaagagataaatagtgtaactttgggaccctgaagattttgtactaatactgatgctaatcattggttgtagagcagtactgtcacccatggcatttaatagtatactaatgatttgattcctggctttatcactttctagtgggtgtctagacatgctacttaatttctctaaactgaagtaatggtagtagtactactgataatagaggcataccttggagctattgtaggtttggttccagactactgcaataaagcaaatataacaataaa

SEQ ID NO: 262781 - DNA, 998 bp, Homo sapiens
aagagagaatttgtgaattggaagataggtctgaaaaaattactcctgatatatcacagggagataagaaaatagaaaatatgaaagagatgttaagtgatatggaagaatgagaaatactaacttaaagaagctgaacatggataaaagaaatgaaagagttcacagatcagaaagcatgacatgcatcaaacagaataaagaaatccacttacacatattgcaaggaaaatgcggcacaccaaaaataagaccttgaaagtaaccggagggaaaaaactgatgactaacagagaaaactaaggcgagaatgggagtaagcttttcaacagtaacaacggaagccagaagagagtagtctatctccagaatgctaaagaaggtagctataaaccttaaattacagcagaagtttgaaatatttctacaatgaaaacaccagaccatgtggtttttattggagtgataccaagctttttaaaacagatcatttcaatcctatacaaatgccttcagagatgagaaagaggaaatactctccaactcatttggtgaggctaagagtagcctaaatcctaaaatcagacaagaagagagaaaggaaaatgaagccaaccctattcattacatagatgcaaagatctttctaagatgtgtaaagtgagatgatggacatgttaatttgttccactatagagtaagtcctcacttaacatccttattaggctcttggaaaccatgactttaagacaacaacttctaacaaaaccagtgttttttctaatcaatgctgtaacgaaacagcattgaaggaaatgacgttattcaaggacctggagttgcagtttccaggaacctgtcgatgatgttgagggctcactacatacatgtgtcttacaacatcatgttgtatacctttacgcaaaatttttaaaaatgtacaaatctgaatctagcaatatatttcaaaaagataacatcatgccaccaggctttaa

SEQ ID NO: 262782 - DNA, 365 bp, Homo sapiens
gcttacttgagggtataagacatgttacttgggggtataaaacatgttaaaaagaaatattgcaagtttaaaaatagtagaaggccgggtgcagtagctcacacctgtaatcccagcactttgggagcccaaggcaggaggatgccttgagcccaggagttcaagaccagcctagacaacatgacgaaacccaggtgtctacaaaaatacaagaagtcccagctatgggaggccgaggtgtaaggacggatcgcttggtcccaggaggtccaggctgcaatgagccatgattgtaccactgcactgcagcgtgggtgacagagtgaggccctgtcctccctccctcaccacaaaggaaaaaaaaa

SEQ ID NO: 262783 - DNA, 379 bp, Homo sapiens
ctcctttatggcagcactaactccattaatgaaacttctgctccatggcttcatcaccatccaaaggcccgccttgtaaaaccatcatctgggggctggggtttcaacacagacattctggggggacacaaacattcagtccactgcagccaaggagaaccagcagagaaccagtcagcctcagaaagaacacttgctgtccagctgcaccggtcttgctgtctgcgcatgaaccttgctcacccaatctgccctaagggtgtctgctaagccctgctcacccctgcctataggggaacaggccttttctgtatgattttgagatgcttgcagattctgagtgttcagccttttggcataaagtttctccttttccatt

SEQ ID NO: 262784 - DNA, 1398 bp, Homo sapiens
gtatttttggagttaatggagtcagaaggacctccagagtcagagagttcagaatttttctcacagcaagaagaggaaaatgaagaagaagaagcccaagaaccagaggaaacaggccctaagaacccccttttacaacctgctctcacaggggatgtagagggtttgcagaagatatttgaggatcctgagaatcctcatcatgaacaggccatgcagcttctcttagaagaagacatcgttgggagaaatttgttgtatgcagcttgcatggctgggcaaagtgacgtgattagagctttggcaaaatatggtgtgaatctgaatgaaaaaaccggtacacactcttacattgtgctgcagcctggggtcgtttggaaactttgaaagcactggtagaactggatgttgatatagaagctttgaacttccgggaagaaagggctcgagatgttgctgctagatattctcagactgagtgtgttgaattcctggactgggcagatgcaaggctgactctgaaaaaatatattgcaaaagtctctttagctgttactgacacagaaaagggatcagggaaactccttaaggaagacaagaataccatcctcagtgcatgccgtgcaaaaaatgagtggttggaaacccatacagaagcttccattaatgagctttttgagcagagacaacaactggaagatattgtgactcctatcttcacaaaaatgactacaccatgtcaagtgaaaagtgccaaatctgtaacaagccatgaccagaagagaagtcaagatgatacctccaactgaacatacgttctgtaaaaggccacattttcttttagtatctgaaaggcaaacctattcatgccatttgaaatcgagaaaacagatgtgggtttctttaagtatttaagtacaacattacatcgcccttgttttgtttgacctgttcagcatgcttatgtccggactctggcctcgcctctgctcctccaagcacagccccatgtgagtttcacgtgctccttcaggaaagcacttgggtataaatcattcgtgaagaccatgtggaggctttaagaactactcagagaatctaataattttctgtgtaattgaggcattccatataaaaggacatatttggctatttccagagaaaaaatttgttctccctgcctaaaaaggaaatcttatggaatgacacttggagcaaggaaatattaagaccagcttggattaggagcctctgggtacaactatcactttttatgtccaaaattaaatttcacctgtgaggtggggtatacctctgagtaaaacccctctttatctttgacctccttctatctgtaaattaataaacacaaatctgtatagttttatacttagaaga

SEQ ID NO: 262785 - DNA, 707 bp, Homo sapiens
gtatttttggagttaatggagtcagaaggacctccagagtcagagagttcagaatttttctcacagcaagaagaggaaaatgaagaagaagaagcccaagaaccagaggaaacaggccctaagaacccccttttacaacctgctctcacaggggatgtagagggtttgcagaagatatttgaggatcctgagaatcctcatcatgaacaggccatgcagcttctcttagaagaagacatcgttgggagaaatttgttgtatgcagcttgcatggctgggcaaagtgacgtgattagagctttggcaaaatatggtgtgaatctgaatgaaaaaaccaccagaggtattttgtcttttttctctcatcagtattacttatgactacctaaagatgcaatgtaatatctttaaggttagatatatttgatgtgcctgttttatactttacatatatgtgtatatacatctatatgggtgtatgtatgtgtatacatgtaaatgtatcaatgttgatattacatagtatagtattttagaacatagactttactatttattagctgtgtgacttggcaagttacctgatctttttgtgtatctgtttttccatctgcaaaatggggataataattatattttccttatagggtataatgaggattaaataggataaaataaatattttagtgcttggcatatcgtaaatt

SEQ ID NO: 262786 - DNA, 661 bp, Homo sapiens
gtatttttggagttaatggagtcagaaggacctccagagtcagagagttcagaatttttctcacagcaagaagaggaaaatgaagaagaagaagcccaagaaccagaggaaacaggccctaagaacccccttttacaacctgctctcacaggggatgtagagggtttgcagaagatatttgaggatcctgagaatcctcatcatgaacaggccatgcagcttctcttagaagaagacatcgttgggagaaatttgttgtatgcagcttgcatggctgggcaaagtgacgtgattagagctttggcaaaatatggtgtgaatctgaatgaaaaaacctacctaaagatgcaatgtaatatctttaaggttagatatatttgatgtgcctgttttatactttacatatatgtgtatatacatctatatgggtgtatgtatgtgtatacatgtaaatgtatcaatgttgatattacatagtatagtattttagaacatagactttactatttattagctgtgtgacttggcaagttacctgatctttttgtgtatctgtttttccatctgcaaaatggggataataattatattttccttatagggtataatgaggattaaataggataaaataaatattttagtgcttggcatatcgtaaatt

SEQ ID NO: 262787 - DNA, 457 bp, Homo sapiens
cagtgaaagatttccatttaaaaacaaagaaactattttcattttagttctcaaaaaatacttagaaaagtagaaattactggagtttagatgacaatatattgaagctcaaaacaaaaataaaatttaactcctaacatgcgtacacacgcacgcacataaaaaactcacatgtgtggccgggcgcagtgactcatgcctgtaatcccagcactttgggaagccgaggtgggcggatcatgaggtcaagagatcgagaccatcctcgtcaacatggtgaaaccgtgtctctactaaaaatacaaaaattagctgggcgtggtggtgcatgcctatagtcccagctactcggaaggctgaggcaggagaatcatttgaacctgggaggtggaggttgcagtgagctgagattgcaccactgcactacagcctggcgacagagccagactctaaaaaa

SEQ ID NO: 262788 - DNA, 452 bp, Homo sapiens
ctataggatccccgtgatcttctgtgccctcgggaagggaatgtgtggtcaaaaagattgggaaatgtttggttaaacaattctgaacagattcttttgcaataagacttctcagaaccttaaataggctgatatgcctggtaaatcactaagaagggccacagaggtgatattttcttaaataaacaatttcttatttgcctaaaaaaccctccttttaaaccactagatctctggccaatcatttagggaactttttcccctaaactctgacagcagagaaaaaaggattgaattaaaaaaaaaaaaaaaaacctggccaatgggagatgggttaggaggctgtggtcatactgcaaaaggaaaatgatgaggacctggactaagagaatggtgttgggaatagagataaatcaacgtaattgagtacatctaaggagacagagtcaata

SEQ ID NO: 262789 - DNA, 379 bp, Homo sapiens
gcaataggaataggaagtgtctgggagaggcgagcaggatgtgcagaagaggctggcgactggacatggcagaagttccagttttccaagtctgaactgggggtcaggaatctagtcttctgctgggaaaagaaccagagacgaacactggactaaatggggccagtcttcagtaggtgaaaccccagctccttgctgaaggtggggacactctgacaagacagaaacaccccagctgtcctcgccacagctcaccgtccatcaaggtgattggtacggagctattttagctcctgacattccagtggtccaggaagaggactggcctcaagccttcaggagttcaacattcaagtatatcctcatcctaaaggtggaa

SEQ ID NO: 262790 - DNA, 2592 bp, Homo sapiens
aaaaagcagcagaacctggaagtccacggggagcttggatgccaaagggaggacggctgggtcctctggagaggactactcactggcatatttctgaggtatctgtagaaaaccacagcctcagatactggggactttacagtcccacagaaccgtcctcccaggaagctgaattcagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactgcgtttcctctgaagaatgctgaagacttagatataggccaaaacaatattgagaactatataatcagccccaactcctattttcgggtcctcacccgcaaacgcagtgatggcaggaaatacccagagctggtgctggacaacgcgctggaccgagaggaagaagctgagctcaggttaacactcacagcactggatggtggctctccgcccagatctggcactgctcaggtctacattgaagttgtcgatgtcaatgataatgcccctgaatttcagcagcctttctatagggtgcagatctctgaggacagtccaataagcttcctggttgtgaaggtctctgccacggatgtagacacaggagtcaacggagagatttcctattcacttttccaagcttcagatgagataagcaaaacttttaaggtcgatttcttgacaggagaaattcgactaaagaaacaacttgatttcgaaaaatttcagtcctatgaagtcaatatcgaggcgagagatgctggaggcttttctggaaaatgcaccgttctgattcaagtgatagatgtgaacgaccatgccccagaagttaccatgtctgcatttaccagcccaatacctgagaatgcgcctgaaactgtggttgcacttttcagtgtttcagaccttgattcaggagaaaatgggaaaataagttgctccattcaggaggatctacccttcctcctgaaatcttctgtggggaacttttacaccctactaacagagacaccactagacagagaaagcagagccgagtacaacgtcactatcaccgtcactgacttagggacacccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggatccgcacctgcccctcgcctccctggtctccatcaacacagacaacggccacctgttcgccctcaggtcgctggactacgaggccctgcaggcgttcgagttccgggtgggcgcttcagaccgcggctccccggctttgagcagcgaggcgctggtgcgcgtgctggtgctggacgccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggcgaggtgcgcaccgccaggctgctgagcgagcgcgacgcggccaagcagaggctggtggtgctggtcaaggacaatggcgagcctccgtgctcggccaccgccacgctgcacttgctcctggtggacggcttctcccagccctacctgccgcttccggaggctgccccagcccagggccaggccgactctctcaccgtctacctggtggtggcgttggcctcggtgtcttcgctcttcctcttctcggtgctcctgttcgtggcggtgctgctgtgtaggaggagcagggcggcctcggtgggtcgctgctcagtgcctgagggcccctttccagggcatctggtggacgtgaggggcaccgggagcctgtctcagaactatcagtacgaggtgtgcctggcaggaggctcagggacgaatgagttccagttcctgaaaccagtattacctaatattcagggccattcttttgggccagaaatggaacaaaactctaactttaggaatggctttggtttcagccttcagttaaagtaa

SEQ ID NO: 262791 - DNA, 1225 bp, Homo sapiens
tttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttaatcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagaacacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagtaaaaaaatagaacaaaacagtcagaaccatgcaccaatttgggatcgataacacataaaggcagcatatcatgttatttaagtgagtacgctttggagccagactgaatttatctcctggatcagccattttctggctatgtgaccttgggcaagttacttttaaaggtatagtccttgacctcagtttcttctattgtaaaactggaacatggcacttacctcattgggtttttgggagaagaaaccactcaaatacataaaaacattt

SEQ ID NO: 262792 - DNA, 681 bp, Homo sapiens
agcagctcctacactgtacatactttgtctgcctccatgccaattctcagctccacgaggccagggcctgtctttgtctatggctctactgccagcactttgccattatcatcccctgaaggaggagaccagagcctcggaccaccaccagcctgggcagggagaccggatgctctactctgacaaataagtggcctggaaaccacccacctgcacgccctgctccaacactagacatcccgacgggccagcagctgccaggggatgaggacccctcagttgctgaggatccagctatgcaccaaccactcacaggggaaagacagtggcttcgttttggagcttccaaggaggggaactggcatactgcacggctgccctactttgccagcctccttcctaatgctctctaaattgtgccacaggattgcatgacctggaatacccaatggcgtcttgtcagggaccggcaagtgcaggaaaagaaagtgccagtgctacactcgggccatgcggccaaatgccactaactgagtggtgacaattcactccagacacccaagtgccttgtttaacctgagagggcaaagacaaccttactgttacaagaaggaaaaaacagatggcatcagggtccctagttcaagattccagctatcactggcagttgtggggtcaagg

SEQ ID NO: 262793 - DNA, 470 bp, Homo sapiens
actgttatagtattcttttcttttttaactccacatgataaagatattaaaattacaatattgacttgttatcagtatatgtgtatgtatataccaattttctttgtttagtaatagtcattcctgtcctttatcccttacatcctaacctatttaacccaaagcttgattagtttatgatttaatctttctgtgattctttttggaaaaaataaacaaataaataactattggcttatctcccctttgttttcattctagcttaagtaaatgtttaggaattcccttgaggtccagaaacgtggagtcacatcaaattgtgttctattttgcatttttgaacatgactgtggataaatcgcttattttacctgcttttatcagtgtcctgttgggagacaggagcagaaaccactttgcatgtttttaaaaaggaaggaatatgatttttagggaataaggttacaaat

SEQ ID NO: 262794 - DNA, 464 bp, Homo sapiens
ggcagttccagggttcctttaaagatgaatcactccagtgaaccagggaataatatgatgaagctacttaaccaaccagtctggtggaatctctaaaaaggaccttcaacgcccttcatcctgagctttaggttgtcctgaataccagaaagccgctggaacatagacggtctcataccgatttctcgtctaaggtggtctgacacccaatggcagggatattgaatcaaactaattgttggtctacacaaaattacaaagccaggctgtgaaggaaaaaaccagaattcttccaaagctaccaggacaggaagtgggaacaacatagttgtactctatcttaagtacatgtcccacacacactgtgcaaacagccaagccggttcccagaaaggacagaaaacatggtgacagaaagtagaatccgctaacccaattcttaagaaataaacatgattcatgga

SEQ ID NO: 262795 - DNA, 624 bp, Homo sapiens
ggtaaatatgaaaagcaaaagataacttaaaattagaaaatggcttcattaagaatgacttttgacacagttcctcactctctaatatagagcagcaacaaagcatagaataacaacttcgaaactgaaagtttacccaaggcagttttttaaattggccttattgaatggcaagtccaattcggaacgtttcttagaatcataaaattaggaatactgtcaagagaaatcatttagtttacctcattaggcagaaatacatgtataccagcattttgtaaagttacaaaagatgttagtaagtattacatgtaactactagatggctcagaatctttaatatgcaaatgtgtactgtgaacattggggatatttcccagtggtatttgaccttgcaattcttaagtcatggagcacctgtagggatcaatattccaccagtctggaaaatactaatttatgccatattaaaccaatagactctgtcattttttaatagtttccaaaaaatccataattatcttttggtgaagctgcttctgtccccatttttgttgttttgttttattttgtttaatattttcagctatatatcacatttggcaccattattgagtggtctgg

SEQ ID NO: 262796 - DNA, 460 bp, Homo sapiens
gttgaatgttaagtcattagcaaaactggactaatttttctcggttcattattagtatattcataatactatctctaagtatttttaatatagtgggaacttgccttgaaattaatataaatattttacgtctttcttggtttgcatggtaatgtactcaggaaacctttttagtaatttggtaagaggcattggcaaagtacctcttttgctaagatttgtagcatcatttgggatgttagtgagtacaggcataccttgcacttcactttattatgcttcacagatattgaaatttttccaaattaaaggtttgtagcaactctgctttgagtatttttccaatagcatgtgctcactttgttagctttttttttgtttttgagacggaatctcgcactgtcgcccagggccaggttcacaccattctcctacctcagcttcctgagtagctgggact

SEQ ID NO: 262797 - DNA, 616 bp, Homo sapiens
aatgacaatagtgatgcatgcagacagtgttgagaaacttagagagtcgatggaaaatttagtttattttaatttaggctgtatgtagctcaaacatatgctgagcttttataattaaatggagtttctttcgaaagtgtgacagctctttgctttctttctacaagattgaaattagagttggaggacttgtgacttctgaggacagagaagaatgtaagcagcagaaagtttctgggaaactttctagattatgatttgaggcgattatttcactgcctataccccagacacctgctacttcctgtttgatggtaaacttttcccttcagtttttataaagagatatggcatctgggacaattgcttggtcacatgaatttatttgagggaggtcagcatttctagacaactttgatatttaggtgatggaatgaaagtcaaaaaaaccagcattgagattttaatttgaaaatactgagttaagtctttagtgttaatagagctatgtttcccagttttgggatttcatgaggaatatgcttgtagagctgaggaatgatgcaggcattatgaacagaattgaaacaaaccatataaaaaaagctctcatcaa

SEQ ID NO: 262798 - DNA, 394 bp, Homo sapiens
gttttcgaactcctggcctcaagtgatctgctcacctcagcctcacaaaattctgggattacaggtgtgaaccactgtgcctgcccagcatcctgtatttttgacaatgtagtttgaattgataacaacttagcttcaacaacatgcaaattctctgctcctatacagctgtgctccctctttatattgttattgctacagtttccatttgtagatactgtgtgttcattgacatagattcataattattgtttaatgcatttaaaaaaatcacatgtgaaagagaggagttacaaagcaaacaacccaataacaatagcttttatattttgctatgtaactagcattgtttatttcttcctatggcttcgttaaatacagtgctctttctttt

SEQ ID NO: 262799 - DNA, 261 bp, Homo sapiens
gcacaggggccggacacaaggcaacgaagtcacagctctctcccaaacgcggcagggcggactcgcagggggcatgggcgtgggtgccacagagcgaggcgagtgggctctcgccgcgtcctcgcaagcccaggacgtccgcccgcaggccacgggcctcccagtctcggcggggcctcccagtctcggcggggcctcccagtctcggcggggcctcccagcgcgcgcgcgcccgcccgccctcccggcccgcggccagcg

SEQ ID NO: 262800 - DNA, 438 bp, Homo sapiens
agcttactctgcagtttgacataccagatgtttctggttcaaattaatcagaaagttgcttgaatttttcagtttttaatcagctgtatatacagcctatggaattcttaaagcaaatagtgttttttaaagaatatattttgaggctgggaactgtgactcgtacttgtaatcctagtgctttgagaggctgaggcaggaggattgcttgagaccaggagtttgagaccagcctaggcaacatagcaagacaccatctctacaaaaaaaaaaaagttttttaagttaattgggcatggtggttcacacctgtagtcctagtttctcgggagactgaagtgagaggatcacttgagctcaggagttggaggctgcagtgagctacagctgtaccactgtgcttcagcctgggcaacagagcaagaccctgtctctgaa

SEQ ID NO: 262801 - DNA, 458 bp, Homo sapiens
tcttacatgatatattcttaaagttttttcttcctaaaaacaactctattccttgaaaaagttggaaaatatagacaaatgtagagaagaaaatcaagcacatgtaatttcatcacacggttaccactaggttactctgttttaattatttagttggttgctgcttgttagtataaatattctctgaaaaatatggcaaagagaaagctcaacaactcccacaatcttaccttgtaccttattaaagtcagagatagtcctgtatcttgctgttaatacgtttttggaggtatgtgggtaacttataaacatgtcagtagaatccaagttaagtactgtattgcctggcaaaatctggctagttcttgagaatcacttgaacctgggaggtggaggtagcagtgagccgagatcacgctactgcactccagcctgggtgacaaagctaggctccctct

SEQ ID NO: 262802 - DNA, 634 bp, Homo sapiens
ctgtttcattccctgtccacctcaatttttatgagttcattgcccgccacggcagaatgtgtgtctcactggttttctcaggtgcaatgtgaacttcatgctacttggttcatctcgtctacctgtgtccttaaaagctagcaccaggctttataggaagaattaacatgttttaatgagagaatgaaaacagtctgcaagttgttttgtggtgtgtctcatggagcgtccttatttatcctccaagtgattagcgggcatcgattctgagttaaggactccatgaggttttgggctaaaacagtgaacaagatactcaagaacttttttattataacttttttattatcttttttattatagaacttccaatccagccagaattaaaaagacaaaattgggtcgggcgcggttgctcacgtctgtaatcccagcaccttgggaggccgaggtgcgtggattaagaggtcaggagatctagacaatcctggctaacatggtgaaaccctgtctctactaaaaatacgaaaagttagctgggcatggtggcacacgcctgtagtcccagctactcgggaggctgaggcaggagaatcacttgaacctggcaggcgttcaaggttcaaggtggcag

SEQ ID NO: 262803 - DNA, 520 bp, Homo sapiens
tctgcctcaaaaaaaaaaaaagaaaaagacaaaaacttactgttttaccagtgttgttcctaatctcttactgtgcctgatttacaaattaaactttagcataggtatgtatgtgtaggtacgtatgttgtactatccacagtttgagatatgcagtggggttcttggagagtataccccatggatagagtgggtgatactgtagtcaaaaggagaactacctaaggtcttgagactggagaagtggtaaacgagagaaagtatgtttcttcagcataagtcacaaaaatagttggtggctatctgtgcttacaaaagcagtgggtagcagtcatggagtcaactgatgaaacttgcgtgtaaatgcatcttagtgtaataacctcacctaattttttaagccttaattttaaaatttgtggacacaagaaaagttggattttaggttaatatctcttcaagtaatgttaaatttacctatctgaatttaaataaacacttctatgttttttaaaaaaaa

SEQ ID NO: 262804 - DNA, 379 bp, Homo sapiens
gactatggctgaattcttctaattttttttgaataaaattagtccttaatgccttgaaatgataagcaaaattatacctatgcgcatttggacattattctagggcttttatcagctcttcagaaacaggtgactcaaaaatgtaagtcctttctaacccaaaggtcaatacggttggcaaagttttctgtaaagagccagagtgttaaatattttagggtgtgtgagccacatacagtctcatgcattttttttttaactccctttattttttttttttctgagacaagagtttccgctctgttgctcaggccggagtacagcagcgtgatctcagcccactccaacatgggcaacagaacaagacactgtctcaaaa

SEQ ID NO: 262805 - DNA, 423 bp, Homo sapiens
attactttttagatggaaagtaacctcctcatggttaaaaaaagaaacagttcaaaagggtaagaaaaatctccctaccacagggaggaaatcagtttctgctctcttataggactgtccgtagctataaagtccctttttaaaagcatatggggcctggcatgcacactgctgtacgcctttctcttcccactcatcacactgctgacaaagatctcctgagtgggaggctttgaagcactgcccccacagagaggtacatgatacccaagaaatgcccagggctggctttggggcccccagattcttaaacgctgccagagcatgtaattgccccagttccttactctaaaattcctattttctggctctctgacttgttttgtttttgtttttttgagactgagtatctctctgttgccc

SEQ ID NO: 262806 - DNA, 334 bp, Homo sapiens
agggttgggtgtgtgtgtgtgtgtgtgtgtgtgtgtgtgtgtgtgtgtgtgtgtttgctctaggcatttagggaaatctgccaaaccactagctaaccacaagctaacaaaatagagacttcagagtccatacaacaaaatatatagcctttaaaaatagtccggaaaaatgagcaaagtgtttgaatagacatttatccaaagagatatttaaatggaaataaacacatgaaaagatgcataacatcagtaatccctcaggaaatgtgaatcaaaaccacaatgagataccacttgacaccatttggatagctattattgataataaataaat

SEQ ID NO: 262807 - DNA, 387 bp, Homo sapiens
gattctgagttaactaacattttagcctagtttcaggcactccccagtggcccaatgagccaccccttcttgcaggcctcaaaatgcactgtgataaaactgcatagtattttcttttccttattttcatgttctaagaaatattattgtccgggcacggtggcttacacctgtaatcccagcactttaggaggccgaggcaggcagatctcttcagcccaagagttcaagaccagcctgggcaacatggtgagaccctgtctctaataaaaatagaaaaagacaaaaccctggtgtggtgatgcatgcctgtggtctgagctactcaggaggctgaagtgggaggatcccttgagccctgggggtggaggttgcagtgagctgaga

SEQ ID NO: 262808 - DNA, 4390 bp, Homo sapiens
  misc_feature (136)..(136): n is a, c, g, or t
  misc_feature (1836)..(1836): n is a, c, g, or t
  misc_feature (2187)..(2187): n is a, c, g, or t
tatcctatccctatcctagcttttaacctgagccagagctcactacacaggttcctggctatcgagtctgaatctgcactactcaacttataaactgtctgcagacacctgttagggaaattgctgatcatgggcngcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttatttacctttttaaacagataaatatttttttttcattttagagtagcggaatctaatcttaatctaatcttttaggagtatatttcagagaaattccaagcacaccagtatgaccatccttatttcagaaatgacaatgcatagaggaaaagtaatatgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcggcaggatctgaactcgctttaccttcttgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctc

SEQ ID NO: 262809 - DNA, 4274 bp, Homo sapiens
  misc_feature (136)..(136): n is a, c, g, or t
  misc_feature (1710)..(1710): n is a, c, g, or t
  misc_feature (2061)..(2061): n is a, c, g, or t
  misc_feature (4265)..(4265): n is a, c, g, or t
  misc_feature (4269)..(4274): n is a, c, g, or t
tatcctatccctatcctagcttttaacctgagccagagctcactacacaggttcctggctatcgagtctgaatctgcactactcaacttataaactgtctgcagacacctgttagggaaattgctgatcatgggcngcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaganaaannnnnn

SEQ ID NO: 262810 - DNA, 3558 bp, Homo sapiens
  misc_feature (994)..(994): n is a, c, g, or t
  misc_feature (1345)..(1345): n is a, c, g, or t
  misc_feature (3549)..(3549): n is a, c, g, or t
  misc_feature (3553)..(3558): n is a, c, g, or t
aattcatagtggttatacaattcataaagtttataatattcattccacttaaaatgaaattaatccatttgatagcattcactttgaaattatgtctatactatcggtattatactttaccgtcatagcatatatttcagaaacctgatttaattgatccatatttgacaatagacttattaaagggtctatttcattaaaatgttttgctatgcacaattttagagagtagaggatattttgatccctaaccaaaattaaaccagtccatttgtgaaatttctttgcttcacctttgtgttttcctcgttccattggtttttgttgttgttgttttgttttattttgtttttctttttaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaganaaannnnnn

SEQ ID NO: 262811 - DNA, 518 bp, Homo sapiens
gcttctcactctgactccaacagggtgagcttgctatccttgtggcacagggccttttgcattgtggatgatggagcggctcgtatagtccataagttttgtgcgtagctgtgtaccctgtccctgtgagctggttctgcccggcacctcggtgacctcgaggaaagaagctgagagacagagtcttgctttgtcacccaggctggagggcagtggcaccatcatagctcactgcagactcgaactcctgggctcaagggatcctcctgcctcggcctccaaaaatggtgagattatggacatgagacactgcactgggcctattgtgtatcttgttggcctaaaattgaaacatgccttgtgagcgtttactgcaacttcaatgagtgattattatgttgcctttaatcctgagagactgtattacttgtgcactttttttttttttggatagggggaaattagatttattccctatatgttttagaaaattgaagttttaaatatcagactcacta

SEQ ID NO: 262812 - DNA, 475 bp, Homo sapiens
gaaggggattgagcctggtctaggtcatcagggcaggcctgccggaggaagtgactttaggtggtagtttgaaggaccagtgggggttgccaggaagaggaatagagagaaccgcggggagacccctgggtgtgagcatgggagccccatcacagtgtcttgggggtgtaactgtcatttaagggataagggccaggaaagtcaaaacatgcacagagcagacccacatgatgagcagttgggttggtatcagcttcttgtgaagtggtgatagaggatggtgtgcaggggaggagtggaagaaacaagaccatgggatgggaggggtgggcaaaagccaggccaggcaggccacagaagccaggtctgggctgcgtgctcagggcagcagggcctctggagggtgtagatggtgaggcgacaggcagatttgtgtttggaaagggcactgtcttcactatggaaaatcagtttg

SEQ ID NO: 262813 - DNA, 294 bp, Homo sapiens
gtggataacgtaaatgcccaagcgctttctattcagtcctcaaatgcaaagcagacccttgctaataatggtaataatccgaatgggtttaactgcagcattgtaagaaaaggcaggcagtactcttagactacaggggtggatctcatcatttgattttcccgactccgccaggaaataagaggggccttggcttggggagaggtgtgtggggaggcgtaaggggtgggccccccggaaatcctgctgcgctgtttaaacctaaggtgacctaacggatggcgggagcggccg

SEQ ID NO: 262814 - DNA, 450 bp, Homo sapiens
gtacaacatactagcagataatatggaatactcatgtgttttaagtgattagccaatcaaggaggcttcattgctccttagagaaaaggatcagataacactggatataaagctggtttccttctagggaggaatcccaatagtaactcaaatgccagacttaagtatttctcaataaagactctgatgaaataattcctagcttttatttgccaatgttttgtcctaatcatatctgcctgtgacagataaattctggtgtaaaatcatcaatgaaaacaggtttttttctcatcccatatttagaaagactcttaatgctggcaaatctccacacaaatatctagaaatgtttgactgatttttaaaaaggattacatattccactggtaatcgccaaagaccgggctcacaagaaagaaaggagaattcctgggtgccagccaggaa

SEQ ID NO: 262815 - DNA, 377 bp, Homo sapiens
ctgagaaatgtgtgtctctatctgtggtgcgttgggtgagtgtatgggctctaggtcagacctagttttaaattctggtactgccatatattagctatggaccttggatagttacctaaccgatgctttggtcttctcatttgtaaataattcatactgtaaagaattcatactggtaatcacagcctggtgagcgtgaagattaatcaggttatacacgcacagggcttagaacagttatgctacaggtaggaagtgctcctgtctatttgcttttcctacgattataattatctcatgtactacttatttatgtgtaaaccatacacagggctagaaaggaagggatttaaaaataaatataactaagtgttctg

SEQ ID NO: 262816 - DNA, 683 bp, Homo sapiens
  misc_feature (503)..(503): n is a, c, g, or t
ctgcctgtcatgcccacctagcctcacccagccccacaggccatggtacacgtggctctgtgatttgggacacccttgcatttgtattaaatgagccacagtcacctgctggcaaaggacaatatcaccatgctaagatcaacagggggactggtggaagaactgtggggcaggagaatctcaatggcattgtctgggtacccagctttgacttgtccttgacacagttaactgcatgtgtctctactctgcttgtaaaataaaaagtgaccactgtattctgtaaaggcaaggacacaagtctttctacctgatgccatgaatatgcctggatatattgacatatgacatggatatatgtccacaaagatggatacatgtgatatatacatgatcatttaaaaagtcgtaaagaaaaatacacgcgaccaacaagtttgtcgtcatgggtatgttgggatgaggtggaaggatggaacattcaataggacagggggttgttnttttttcttttttttttccctcttcctttctctttctctctccctctctctctttcttctctctctccctttctccccttttctcccttctctctcctcctttcttctttccttcccttcccccccttctctcctcttcctcttctccccctccttctccccttcctttctttttcttcc

SEQ ID NO: 262817 - DNA, 477 bp, Homo sapiens
tatacctatgtaacaaacctgcaccttcagcacatgtatcccagaacttaaagtaaggtaaaatagtgtacctgaatcaaaaaaaaaaaaaaagaaaaaaaaagaaaagaaaagaaaagaaagaatagtatcttcatcaaggagaactagaaaagatagcaaaacctagataccaaatcccaagggaacagaaggccttagaaatgacaagaagttggatgagatgaagcacctggaattgatgttgttgttgttgtgtggctttttatgtgcttgatttgtttgaaagagcaggctgcatttaaaggacttatttttcaagattgtatgctctaccaagaaaacagacatgtacacaatgaatttaagacgcactataaaaaaatgtcattttagagatgcaatagggcaaggataaaaagcaaaaaaaacccagctcaaaaagagagaaagaggatgagttagcgagagtgttcc

SEQ ID NO: 262818 - DNA, 148 bp, Homo sapiens
ctaactggtttggggcagcagagttatcatttggaaaaaaaatacagttagattaaccccctataggttaaggtttaaccccatagagattaaggtttaactgaaacagatgaagccttggaagtactaaaaaaaaggacaggcaaat

SEQ ID NO: 262819 - DNA, 531 bp, Homo sapiens
aaggtctggggtctctgccaagtagaaaaaaggcccagagccaggcaggcagctcagggcaaaagtcaggatgccccgattccagtcccaggggcaggagagtacagctgcccaagcaggcacactgcagacggccctggcactgcctcccacctgctacaggaccttgagctggtgctgatctctcagcctgtttcctcatttgtgaaggggaagatgtttaagtactattagtaatagtcacatcatccctaactggtttggtcattgaggattattcattcattcagcaagttttcattgaacaccaggtacttcacagacatgctccctgctcttggaaatgtagcgtttagttaactgcttgaggtgagaccttgggcacatgacttattctctcagagcctcagtttcatcatctgtaaagtggaggtaagtattcctacctcactgagtgaatttgagaattaaataatacttgtaaaacacttaggacagtatcaaataaatggtgagtgataaatgtgaact

SEQ ID NO: 262820 - DNA, 458 bp, Homo sapiens
actgtttggcaaagtgggttgggacacagtacattttgcagcttagcagcattgtgtttttctgagcaaagacttcgcacaggggctggggccacctttagggactgctgtggtctgaatgtctccccaaagtcacatgttgcaacttaatcaccaatgtgatagcactaacaagtggggccttcagggggtgattaagtcatgatggtggagctctcataaatgtgatcagtgaccttataaaatgtgattagtgaccttattagtggctggaggtaactagccccctttcgctgttctgctcttctgccacgtgaggatacagcattctaggcaccatcttggaagcaaagacagaggccctcaccagacactgaacctgctaatgccttgatcttggacttctcagcccccagaactatgtggaaataaatttctgttcttttataaatgacctg

SEQ ID NO: 262821 - DNA, 694 bp, Homo sapiens
acatgacatgaatgctttccatgtcattaattaggcatctctattagtttcattatattaatttattatctatataggatttataatttatttaatcaagctgctattgttgaacattaaggtatttctactttcctggacataaagaataaggctgtgaataatatgtctttgttcaggcttcatatttttaggcataaattcttagaaatggaattgctgaatagatgaatataagcttatctatatttttaaggttttttgatatgtttaatatgccattttacatatttttaaaaatctatgtacacaaataactatagaagtgtagaagtaggtgtgtcttttaccccacatcttagtttacactaggtactaccattaaaaacatttttcattgtataatataatccagatacaaaaacacacatgcatatatatgtatatgtgtatatgaaatataataaggcaaatagccttgtcactatacccagatcaagacgtacacatccagctacccagaagcctttctgtgtgttccatcctgatcacaactactctctactttcctgcagaggaactgtgaaaatatccagggactctccttacttttgtatcaatccctttcttgcatttctctgtggcttcatcaccaactatgtatttataggcattggggttcactctcgctcat

SEQ ID NO: 262822 - DNA, 340 bp, Homo sapiens
gcaactcattctttttcaaaccaaaaattattagacccaaagctaaacagcaccttgtctaaacacataaaacaaacttaaaaaaaaaaaaaaaaacctcttcctggcatttcccctcattatctaatatccaagtgacctgcatatttctgattgctctctttctcccctcccatttttccctcttaagccttgccactgagagataatacatcagtttttcagaaaattagcagcagcagcagcatgtccactttttctaagttgctttagttttgtttgagttttaagataaagcctatttccagggaatattttctttcctgtgttgttttacact

SEQ ID NO: 262823 - DNA, 369 bp, Homo sapiens
gtagtcatatctacatagaatggtcaggagtgggaaactttacttatgctgtttggcataggtaacattttaataggcaaacattgcttgctcaaagtgttccagtctgagaaaatgtgcaggaggaacagcgtggaatcagtgtatgtgggagacagcatgtgttgtaatttggagcattgaggctatatatgagagaacacatgagagaagagtggaaaggcagggctgggtctggtatgctaggggaaagcctttgggctttattgaatagatcacttggagatactgccttaggtttggtgatggggaatggatacacgatactgaaggaacagtcataagcataggctttcaagagatgtggag

SEQ ID NO: 262824 - DNA, 704 bp, Homo sapiens
gagcctttttcacttgaaagtgctcatatttagacctgtgacattactttcaaaggaggttttatatacaaattgtagtcacagagatcccccagcagaactggaagatcttcttcatataacttaatacttttatcttgtttctaggtcacatcctttatagtgtactagaatttaattatttctataaatcttgtaattatcttgggaataacagaattatattccccccccacctttttttttttttttttttaatttaaatggagtctttctctgttgcccaggctggagtgcagtggcatgattttggctcattgcaacctccacctcctgggttcaagtgattcttctgcctcagcctcctgagtagctgagattacaggcactcaccaccatgcctggctaatttttatagttttagtaaagatggggtttcaccatgttggttaggttgatctcaaactcctgacctcaagtgatccacccgcctcagcctcccaaagtgctgggattacaggcatgagtcacagagtgcagtggctctgccctgtatttttaatgcctctcccaaagccattaattacatctaaggtataccataattgttatcaattctgttttgcatttttttcttaaaactgttagtagtttatgcctgtcctgatctcagagagctcctgggcttaggacataagaatttg

SEQ ID NO: 262825 - DNA, 500 bp, Homo sapiens
taatttacagagagaaatgtaactgccaaagggaccggatacacgtgtcctccagccaacacgtcagctccctgcaggcacactccgcagaaagccaagttcaaatcaaaatggtgcttggcttgcttctcccaggcaggctgcctgatggttcctggatatgccgtgtgtgtccacacctctgggcctctgctcagtgtagagatggcatacaggaactgaatggatgagcaggtcactgagcagacacgctggggaaagcaccacgtggagggaatcaagagagctggattctcattccagtcttctggctcctcaggaaataacacaatagagacaaagctgaagtccctttatctactacccaagtcccacagataactaatgaatttggtgtatatccttctcattattttccaatattttaacatacctatccatatatttagcatttgatattgatttatgtcttaatttacataaatggtatcatatgattc

SEQ ID NO: 262826 - DNA, 377 bp, Homo sapiens
tgtggacctcattactgactcccatccactagcttctggtaggctttggcccttgggagccatcagaaaggcaagaaatcagacggcaggagtagagggatactggtatttattttcagttttctctctccacgttgccctaggttggctccatcccttcaccaaaggccacagctccagccagacggtgtcctctccatggaaaactaccttttctaggctcagggaaacagctccctttccttgcctctttgggactagggatgggaagggcccccactgttgctagtcccaagggactgcactctcctccttggtttctctaaacctgcccacacctttataaagagtcgctgttattaaagtcctgttacatt

SEQ ID NO: 262827 - DNA, 324 bp, Homo sapiens
tcgtctctccagcacgagggagagagtggtaactccctccttgagttgtcgtgaggattatttattgctgcagttaaggtgcttagggcagggctgagcacaaggtaagcatcagcccgttagccggcattatactttgccttctatactttgccttctcgactagtgatacaagttatcttaatttaaatagaatccattctgtactactgattctttttcccctttacatttttttaaaccaaataaacaatagctttccatattccacaaaaattgtgtcatatttgtatcacacatgtatgatgatcttatgtttacgat

SEQ ID NO: 262828 - DNA, 357 bp, Homo sapiens
cagactgtggatacctttttaagaaactgacttgcagatggactagatgaagggcaaggagaggagtcaaggaagaggccaaaaatacttggcctgtgtgattcaaagaatgtacgtactatctgagatgggagaggctatggtaggagtagtttcagtagagagggggtgtattagtcctttctcacactgttatgaagaaataaccgagactgggtaatttataaagaaaaggccgggtacggtggcttacgcctgtaatcccagcactttgggaggccaaggcgggcagatcacaagatcaggagatcgagaccattctggctaacagggtgaaaccctgtctctactaaaaat

SEQ ID NO: 262829 - DNA, 451 bp, Homo sapiens
acttagaagcagatccttccccatctgacactttatatgagactcaacttctggccaacactccaactgcagctttgataaaggccataaatgcttgctattttaagccaataaatggtgtgatcttgactcactgcaacctcggcctcccaagttcaagcaattctctgcctcagcctctcgagtagctgggattataggcgcccaccaccacacccagctaatttttgtatttttagtagagacaggtttcaccatcttggccaggctggtcttaagctcctgaccttgtgatccaccagcctcggcctcccaaagtggagactatttatttaaataaacaaagttgaaaacacttgcattaaactgaatcacaatagaagaatgctatatgcctaattgtaacttattccagaaatgccaggatggttccattcataggttaaaaggg

SEQ ID NO: 262830 - DNA, 424 bp, Homo sapiens
tatgcagggaagcagtgcctccccagagctcagaggctgatgagggaggcaggcaatgagcaaggaaacagtccatctccagctcggggccagctaaggacggccttctccaactctcccctcttgctccagacacagtctatccatttgaggttgctgtgcaagaggctgccccgggggatgatgcccggccctgtgcacaacacaggctgcctctctgctttacacaaaggctccttaccagctagttctgtgattctcagaggcccacagcatcctcaggcttttgacaaccaggctctggcacccactgtgtgccagaccctggcatctgcctggctcaggggtggtcactcacgtccccagctgctggccttggagcaactgctaccagggtccagctgcaagcaggagcctgcggccg

SEQ ID NO: 262831 - DNA, 937 bp, Homo sapiens
tttagtatcttgtaaccacgttttttacttcaactatccaaaaaaaaaaaattgtgggtcagactaaaacatgcaaagtgtagaagtcagttacaatataggcagaccctttttttcttatgtgccaggtggaaatagtttccatgtgttattttacacatgcttccgacgtgaggaaatactagctggaaagcaactttaatttccagagaaatgcatgtaaataagaaactacttatctatcatccagttttcccaattgggtgaagggatttggggcaagagcacagggcatgaagagagtaaacagtggggaggttgtgggagagttgaagtgggaagtggctcctgtggaccaaagacatggctggcaggacagagaatctatgaagacacagatggggtaagcccagaaaagcatcccaaggcacacacataccttgttttttgtaaatctcctttatcttttattaccaaggtaaattataatctcagatttgactttgtggtcactattttgattaagaaaacaaaaatagcattcactccttaagaacttacacgtctgtgactaatgcctacagtccttgttttttacgcctagacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262832 - DNA, 696 bp, Homo sapiens
cactctggctctggtgttctgattctcacgtgttgttcccctcccgttctccagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262833 - DNA, 420 bp, Homo sapiens
ttaatctctagctctctctgatgtagaagtcctctactcaccacttaaactatttcattactaaaggaccatcacttcttctgaagaacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262834 - DNA, 2163 bp, Homo sapiens
tccggatttgcagggtccgaaggagaatacatcaaagtgatgtcattcatgactccgaaatggttaccatggcgactatcagacatattaagctgtcagggaaagagcctgtttaatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtgaaggacgcccgccctccccagaacttgagagcttattggttggcgatgtcgtcactcagagtgacgtcaggggcgaggaaagaagcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262835 - DNA, 2078 bp, Homo sapiens
tccggatttgcagggtccgaaggagaatacatcaaagtgatgtcattcatgactccgaaatggttaccatggcgactatcagacatattaagctgtcagggaaagagcctgtttaatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtgaaggacgcccgccctccccagaacttgagagcttattggttggcgatgtcgtcactcagagtgacgtcaggggcgaggaaagaagcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262836 - DNA, 1608 bp, Homo sapiens
aaaaacaaacaaacaaaaaaacaattttaagtaatacaatgctattaaagtatggaccctctaacatagatgaagtctaggagatgccaataatatttttattgtcatagatttccttcaagatagcccctaaaagttacttcagagctatggtaaacaggaaaaccctgcctcttcattttataaacagctgcagaaaacctgtcttgggtttttaacactttaagaaccaagctgagcatggcacatatgcctgtaatcccagctccttgggaggctgaggtggaaggattgcgtgagcccaggagtttgaggccagactgggcaacatagtgagacactatctcttgaaagaaagaaaatgaaacaagacagggtttttttggttttgtttttcatttttgtttttggcatgccctaaaataatgaatattgcatatgcatttaattctatagctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262837 - DNA, 1070 bp, Homo sapiens
aaaaacaaacaaacaaaaaaacaattttaagtaatacaatgctattaaagtatggaccctctaacatagatgaagtctaggagatgccaataatatttttattgtcatagatttccttcaagatagcccctaaaagttacttcagagctatggtaaacaggaaaaccctgcctcttcattttataaacagctgcagaaaacctgtcttgggtttttaacactttaagaaccaagctgagcatggcacatatgcctgtaatcccagctccttgggaggctgaggtggaaggattgcgtgagcccaggagtttgaggccagactgggcaacatagtgagacactatctcttgaaagaaagaaaatgaaacaagacagggtttttttggttttgtttttcatttttgtttttggcatgccctaaaataatgaatattgcatatgcatttaattctatagctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggtatgattttttaactttaataaaatttaataaaccttattagaggagtttttaggtttacagaaaacttgggcagaaagtactacttctccccacccaaccccatcccaatttctcctgtaattaatatcttgcattagtgtgctatatttgtaatgattaaaaaaaccaatattgacatgttattattaaagctcatactttagggtccactcttcatgttgaagcatttctgtgggctttgcaaatgcataatttcatgtatccaccatcacagtatcatacaaaatagtttcactgctctaaaaattccctgtgggccaggcacagtggcttatgtctgtaattccagctccttgggaggctgaagcaagaggatcacttgagcccaggaggtcaaggctgcaatgacctatgatagtgtcactgcactccagaggcactgggtgacagggggagaccctgtctca

SEQ ID NO: 262838 - DNA, 1607 bp, Homo sapiens
tccggatttgcagggtccgaaggagaatacatcaaagtgatgtcattcatgactccgaaatggttaccatggcgactatcagacatattaagctgtcagggaaagagcctgtttaatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtgaaggacgcccgccctccccagaacttgagagcttattggttggcgatgtcgtcactcagagtgacgtcaggggcgaggaaagaagcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtgtccatcttttatgtaatgccgaacaacttcggggctgggcgttctatgaaaaacgcatgtcatcatggatttcccaaattgttcaccatctttggaattgcaaatatctaaattatgaacatataatattgtaaacatttaatattataaacattgatagtagtttgcagaaaagcctgtcttaaagtaatcaacgttttgaagacattgataacttcttggagagaacagtagatttagagtcaaacttccaaactcctgatttttcagctgatgtagtttgacttcagatggatatcttttctttatac

SEQ ID NO: 262839 - DNA, 468 bp, Homo sapiens
cgttattacatgatgtagggatgagcaataacaaggagacagttatttttctcccatctttatctaccaatttacaatcacgaaggattgagtaacttttattcttctaccattaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtgtccatcttttatgtaatgccgaacaacttcggggctgggcgttctatgaaaaacgcatgtcatcatggatttcccaaattgttcaccatctttggaattgcaaatatctaaattatgaacatataatattgtaaacatttaatattataaacattgatagtagtttgcagaaaagcctgtcttaaagtaatcaacgttttgaagacattg

SEQ ID NO: 262840 - DNA, 2256 bp, Homo sapiens
tccggatttgcagggtccgaaggagaatacatcaaagtgatgtcattcatgactccgaaatggttaccatggcgactatcagacatattaagctgtcagggaaagagcctgtttaatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtgaaggacgcccgccctccccagaacttgagagcttattggttggcgatgtcgtcactcagagtgacgtcaggggcgaggaaagaagcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262841 - DNA, 1592 bp, Homo sapiens
agcggattaaccgccgcctcaggtgtcgtctcctgcccgcgaaacaccacccaccgttagtgtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262842 - DNA, 1171 bp, Homo sapiens
aacagtaggtatgatttagtcagcccaacagacagttcagcagcccctgagaagagggagccttcactgagtgtggcagtcactgtgccggtgagaaaacagaggcagctccttccttctccccgttctgtgccactctactagacagcgttgacagcatatggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 262843 - DNA, 334 bp, Homo sapiens
ataaatcttacctttcatgagaaaatgaaagacaatactggcttatcaggtaaactctggaaatttcctgtcacatagagctgaatacaatctctcagtatgtgttcagttattatgtttgattatgtattattaaaacaaaagtttctgtttctgagaaatatctatttactgtgtttgtgtttttaaagaagttggattctatacaaatggataaaatgtttcttagaaatagcctatttaactgagtttttcaaataagttgtatactaacaaatgtcaatctctgttttttatttactgggagaatgtattaaaatattgaaaattgcca

SEQ ID NO: 262844 - DNA, 305 bp, Homo sapiens
aaatatatatatactggtttgacacagatgctaatgtgatgattaatggaaagcacaaaatgatttttaaattttagttaagtagctcagatcgggaaaaaaaaagtcttaagaatacctttatgtagtttttcccaacactagatggcaggcaaaaacttcattctgaattgtttacatattacttgccagagtcagtcagtaatataactgactagggttggatcactggtgggactttttaagtacattttatttttaattattttacattttatttcaggagaacatatttgctgattttt

SEQ ID NO: 262845 - DNA, 399 bp, Homo sapiens
agctcctctcccattctaaggaatgagttatataactcagaaatctcaggacagagggaagcacagacctgcagaacaccgctagctggaagggaccatcgagacgacctagtccaagtcatttcagaggagaaaaccagggctcagagagggctagtgatttgcttgaggtcacatagctagcaagctgaggctggaagcaggagccagtctgcaggagggctgctgaggtgtctcagagtcccaggacatgcacttgctgctccagagaggcaggtttccctgctttccttcccaaacacttcgatggaagtctccctccagctccagccagggccagggtttcactgcagctggatctcagtgctctgagatgggagaggctggcactaatgtttg

SEQ ID NO: 262846 - DNA, 428 bp, Homo sapiens
aaaaaaaagaaagtaatagtttagtaatggtattgtgtaacttacactgtcaagagacgagaaagttagtgcttttaaaatctgggtagttggaactaactaggctttagagagagtacattatttggtgaatctaagatagaatttagctctttgaagtgatttaaacaaattgtgtgatattcaaaatagaaaatgcaatagatctaggatgtattatataattttattgtaactgatataattctttctccattttaaatatcagataatcctgtcttttggtatttgcatatcactattaaaatgattttcattcgttatgaaagagcaactgctaacagctaaccccacagaatgagagcagatttaacataaattgctctttcttaaataaaatgccagcagagggagcccaagaactattt

SEQ ID NO: 262847 - DNA, 444 bp, Homo sapiens
atgctggtttaggtttaggttaatctggatgttctgtaatgaaaccacattatagatagacacaggaaaattggctagtaggtcttgtgtcccctcggaatccattctgtcttcttgctgtaaaagctgagacttgatgcccaacagcagcctcatctagagcatcctgcctttgtaagcctgctgaattgtgattcacagttccctgggtgaggggtggtgataaagcatttaaagaggactgataataactaggaatacttatgctaggaagtgccagaagactttcagagcaatttgtctttaagccaggtgtagtggcccacacctgtaatctcagcactctgggaggctgaggcaggagaatcacttgagcccaggagttcaagaccagcctgggcaatatagtgagacccctatctcttaaaaaataaaaaaggaaag

SEQ ID NO: 262848 - DNA, 2195 bp, Homo sapiens
  misc_feature (42)..(42): n is a, c, g, or t
  misc_feature (44)..(44): n is a, c, g, or t
  misc_feature (1076)..(1076): n is a, c, g, or t
gcgatggcaggttcgccgggtgtgaggcttcacagcggtccngngaccaagtcgagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagtcagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatnagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctattt

SEQ ID NO: 262849 - DNA, 2189 bp, Homo sapiens
  misc_feature (1070)..(1070): n is a, c, g, or t
atggagatccagttcaattatgaatctcaggaacaccaccttctgtcgagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagtcagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatnagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctattt

SEQ ID NO: 262850 - DNA, 161 bp, Homo sapiens
aaagagagagagagatgggtaacttgcccagggtcacgtaatagtgagtggcaggcctagcaggcattcatttttcgtataaatatttagacgcattgggggtatagccataaacaaaacaaaagtccctgctctgtggagatgacagtctcttggggaaa

SEQ ID NO: 262851 - DNA, 525 bp, Homo sapiens
aagcaaattcctttttaacttaatgattatccaaggctgcatggcttttatctttttattccgcctctcagatccatagctctagtcctagtgatagtgacaagaggcagagaaattctaggcagagaggggtggatccctggtgaagccccaccctcaagccaaaaagcctgagaccacagcccaaagtgagaacttatatccccattttcctgcttgaatgttgccttttcctaaactaccatggtcctgccctgccccatcctgtgcctataaagaccccagactcagccggtagagaggagaagcagctgcatgttggggactacggccaaagtcagagagaaccagcttgacttcagagggacagcttgacagtgtaacttcaaagaagaatctggccagagactgctggacctcaggggaagattacctacattccctggccccttttcaacctcccttccctctgagagccactttcatcagcaataaaatcctccacattcaccatccttcaattca

SEQ ID NO: 262852 - DNA, 150 bp, Homo sapiens
agaaaagcaaacagagagtatggaaataaatacccgtcagtatagaaatgtagtatatcataaaaatggcacttcaaaccagtgggaagcaatgggtcattccgtaatacagtactggaacaggttaataaaaaattacaaagtttaatt

SEQ ID NO: 262853 - DNA, 473 bp, Homo sapiens
taggaaatagtctcttggatttctttggatctgggtcctttctttggattctgagttattgtgaggcatctatgtagtttttctagaagtattcaaccaactggaggatcctagaaccaactatgtttcccagggatctctagtatttctagcaatgaaaatattagacatacctggagaagatattggagatgcctggagatcacactccatcccatacccccccatatatagtttcagtttcaagtgccatgcgtcaattagattgtagagtatgagtctagtcagttagcatctctgagagatttttaaattaacgctgtattgtgtatatgcagcaagggcagaagcaaccctggtatataatttcacatttagattataagtaagatatattggaaaactgtagtaggcagccaatatgatatacctgcttatgtatagcagatgactgagaaaacttcaggtaacct

SEQ ID NO: 262854 - DNA, 392 bp, Homo sapiens
gcaaagtgacttccaacaagacaggggtaaaagaacctgagctagagtccagacaaccaaatctgttaaaggtagaatatggtgatgggtgctgtgcaagaagaaggagggaagaaggaagctgagtgtgcagcaaagacacctgcagggacacatagaaccaggcatttgctgaaggacacctggattgcacaaccagcggctaacttgcatgaaaaaacattctaggtggttttgcttaatgttggtctctccaactgtgctacaagctccatgaggtgaaggaccaagttaattgtgtcttccatggtatgtcccagtcctgccactttaggcattttaaatatttgctgaatattgtttgaataaataatttgtggagaattggaaga

SEQ ID NO: 262855 - DNA, 620 bp, Homo sapiens
gaagacaggtgtggcctgtgggtgcttgatacatggtggtggctttgttactgaataacagggaggtatgattgcaaaggtcactgttgccttcaaactctacattttggtttgaattccttctgaaacttgcttcttgcacatctctgctcctgtagtccatccacaaagggccatctgaggaaacttgctctgcaccacgctcccccatggtgccaggaacacagcagtgcacaagacagacatgagtctgctgggaaagaaacattaggcaaatacagtcatccctgggaatctgtaggaaattgcttccagggccatgggtaagacatgaaaatctgcacatactcaagtcccatagtgagtcctggggaccgaaggttatgaaaagccaggcttccgtacgggcagatttaaatcctgagaatactatattttctatctgtgtttggttgtggatacaaaacccacggactgtattttttggattcaaattggtatcgcaaccttattaagactgtcatctgggatttgattttatccttcttagaagctattcagtcaacctgctactgtttcctggatgttatgtccagccgcacttctgtgtcagttcccct

SEQ ID NO: 262856 - DNA, 567 bp, Homo sapiens
accctatgtttaaaaaaaattgtgtacctggtttagaaaaaaaagataaaaggatacaacttaaagtcagtcatcttcctgcctcttctccagctattttccctcctgacaggcaaaggcactgatgcaaaaatcactcaggtctcctccctgtgacttggtgcacacctgggcatcactgtcttttacacactgatgtgtccctcgctttcttttttaaagggaggtccgtaaccacccacctgcctccctcttgtctttatggactgcgtgatgtcccaccatatggatgctctcgggcctagcgttccaccgtctgcagctggggaacattttgtttgcagctaatcattgtcatgaatatcgtttatgtgtgccttgctgtgatggtgtctgtgggataaactcttagaattggaattgttggattgagaggtatatgccttttatttagatatagatgaattaaaaaaacctcttgagctcaatttatactcaatataccggggtgcctgtttgccatgttttcagcaaaactgtattaaaatatgtttttttaacctgata

SEQ ID NO: 262857 - DNA, 315 bp, Homo sapiens
cagcctggtgcactgtgcgtcctctgagaggtgaaggagcactgtgtggtcagagggctgcgagctctctgtttgggttccgaggaagacagaatgggctgaactggaactgacctaaatgtcagcaagaggaggtctttttcagtgtgctcaatatggtcaccaagcctggaaacatagacagagcttcattcttgttgctcaggctggagtacaatggcacgatctcggctcactgcagctgccacctcctgggttcaagcgattctcctgcctcagcctctcaagtagaaatttttttttatgtgtatatat

SEQ ID NO: 262858 - DNA, 1997 bp, Homo sapiens
cgctcctcggtgagcacccggcgtggggcgcgggcgcgggcccgggcggagagggcggtccggatggagccaggctaaactcattgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccaggtctttttcagtgtgctcaatatggtcaccaagcctggaaacatagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcaggtaacctgcgtgctttataagcctctcacctgtcgcgttttccctgtgttgcgtttcccccgtgtcgcgtttcccctgtgcaggctcaagagctggcggaggggcatttcccacggtg

SEQ ID NO: 262859 - DNA, 3454 bp, Homo sapiens
cgctcctcggtgagcacccggcgtggggcgcgggcgcgggcccgggcggagagggcggtccggatggagccaggctaaactcattgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccaggtctttttcagtgtgctcaatatggtcaccaagcctggaaacatagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaacttacaaaacagcaacaccacacaatcggaacacacaacaattggtgggcggccttcggcctggaaaacgttttcaacacccaatccgttggggcgccgcgccccagtctggtagcttgcacatggcataagtggttccctaaggaaaccgggcacatgcaacagggcggggttccaccatataaaaagggcggggcaccgcgcggtttgaccaaccccagtgggtcggaggcctcacggagttatcacggggccagagacgatatccggggg

SEQ ID NO: 262860 - DNA, 2942 bp, Homo sapiens
agagacatggaaaaggcgacgtcccagcggctggaactggggcggaggaacgggaacagggaaggcctgagttaggcaccacaaaggttttcaggagaaaagtggggcgagccgagaggtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaacttacaaaacagcaacaccacacaatcggaacacacaacaattggtgggcggccttcggcctggaaaacgttttcaacacccaatccgttggggcgccgcgccccagtctggtagcttgcacatggcataagtggttccctaaggaaaccgggcacatgcaacagggcggggttccaccatataaaaagggcggggcaccgcgcggtttgaccaaccccagtgggtcggaggcctcacggagttatcacggggccagagacgatatccggggg

SEQ ID NO: 262861 - DNA, 2957 bp, Homo sapiens
cagcctggtgcactgtgcgtcctctgagaggtgaaggagcactgtgtggtcagagggctgcgagctctctgtttgggttccgaggaagacagaatgggctgaactggaactgacctaaatgtcagcaagaggagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaacttacaaaacagcaacaccacacaatcggaacacacaacaattggtgggcggccttcggcctggaaaacgttttcaacacccaatccgttggggcgccgcgccccagtctggtagcttgcacatggcataagtggttccctaaggaaaccgggcacatgcaacagggcggggttccaccatataaaaagggcggggcaccgcgcggtttgaccaaccccagtgggtcggaggcctcacggagttatcacggggccagagacgatatccggggg

SEQ ID NO: 262862 - DNA, 434 bp, Homo sapiens
gacactacaaattcgctggtcactggacattacaagaaaaacctggttctcatccttaatcattgtgttcatcacttaagtcactcataagcagtggcaatttttgacactttccactcttgtcaagtcttcaatatattttttctccttgcctatgcctcatttgaagcagaagaccttagaatatccttcaatgacaacgataacaacaatgtcaattttaacatctatccattgagtgctgcgcacattccagatgctgtgctagtacgtcacatcgatgattggatttagtcttagaaatccttcaagatagtatatactattcttatttgagaaaagaggaatccagtcctcagagattttgaagttaattgcttatagtcccacacggactaagtcgtagtaccaaaatacaaatccagctacttaag

SEQ ID NO: 262863 - DNA, 435 bp, Homo sapiens
agcccataagtggccaaagcattgttcgtactcaggtttaaaagaccagaaacctaacatcatttgtatttgtctttaggtcctttatcaacacatcaagacatctgagctttttccttatcgtcatctctgtaataatgaagaatatataatgaatggtaaaattcaggttttaatgtgttcttttattaacctgaagcagaccttgcagataagccagagatttttaagtctgagtataagttgatggctgtttccaccatctcctactcttcaagccctcaggcttgaagtttcttggtgtttgttcatgaacatgcattctgatgaaatgcagagcattctaaaatacttggcttgctagtggatctttagagattttccaacagctgagtgttcaggacaaaccttcccccttcacacctccttaggatc

SEQ ID NO: 262864 - DNA, 643 bp, Homo sapiens
agatggtttcaaatcactcaggtgaaaggaataacatagccatgtttagtctgaatgcaaaatggagatggtaaaaagtacataggattccaccaccagtgggaggacagaattgtattgtggcagcaatctgtaaatataatatttatcactcattcacatttatttagagtctaatgtgttctaggctctgaaattaagcaaagaaaatctagatatgcataagtccaagactttgcctttgtgacagccaaaataatgacaccataaagatgttctagtccctggaatctgtgaccatattactttacatggggcaaaagggactttggagatgtgattaacccttgagttagggggattatccttgattatcttgggggccaatctaattgcatgtgtctataaaatcagagaatctttcctagctacagtcagaaggtgatatgactacagaacaatggtcacagacatcccactttactggctttgaagatggagggatggtcccatgatccaaggaatagggacagcatctaaaagtcagaaaaggaaatggattctctctagagcctccagaaagcaatacagccctgacaacagcttgacttaagcccagtaagaccacagtcagaggtcttcc

SEQ ID NO: 262865 - DNA, 688 bp, Homo sapiens
ttagttaataccctcaagataacatctaggttcttagctgcactgagtcaagcctacttacatctttttttatcttcggctgcacttttcctatcacatcacactccagcaatgccaagctgtgccgccttccaccccatctccactattttgcccccgctgccgcggcttttttccgccttctcagcggctttttgtcgccacgcctttttacccccgccgccgcgacttttcgctccccgccgcttttttcccccgccgccggccgcggcttcttgcgacttttttcccccgctgccacggctttttgcccccgccgccgcgacttttgtggatttttgcccccgccgccgctgattttgcccccgccgacgcggctttttcccccgtctcagcggctttctgccgccgcggctttctgtgtctttttgcccccgctgccgcgtctttttacggctttttgtccctgccggtacggcttattaccgtcgcggctttttgccccctaagtcacggctttttgcccccgccaccgtggctttttgcgtcttttttctccccgctgtcgcggctttttgcccccgccaccatggcttttgccgctgaggctttttgcacccaccattgcagctttttgccatcgtggctttttgcccccgccgccgcggctttttgcggcttttttccc

SEQ ID NO: 262866 - DNA, 831 bp, Homo sapiens
tccattttcagtacttacaaagagcctcttttgaccactgaagcaaagattttttaaaagctcttctgaagaaagggttaattcatcataatacaatctccaaacaccatgttgtcagctcaggcttatgggaaaaggaagtgtgtgtgacagacagcaagggacaagacagactccagagagccctgaggaagcaaacaccaagcccactgctatgtctctggaaattacagtttaaatgtgtctttagtgaaaatgaatttatctagttcctaaccatataccgtcatgtcatctcccctcaaaaagcctgggcatggcactggggacttgcaataaatagcctttaaagttattgatctacttttcgtggtcacatgaccatcttgatggaagagggcaaagagggaaaggagctcctgcctgtccctgtttcctgggcagggcattcagcttacatcatgccatttagccctaaggcctcctttctaggtattaggggtggaaatatttacccaagttggttgattatttaaactgcccaaacttatgaagtcaactattcgttgtttcaatctccaagtcagaatccagactgagttctttctcataatggcaaatacagaacaaaattcctgacgtttctcaatggacattatagtttatgtgcctggtttccaggattagtcattgtttactggactgcaataagaaatatcaaaaattgacaatcttgcccgacagtttcatctccacacaaaaatggataagtataagtataaatcaccactagtttttaatctccttatataaagaagaataccacaacca

SEQ ID NO: 262867 - DNA, 350 bp, Homo sapiens
taaaaattttgttatcaaatcccagtttcatcatgtttcaaatataaatagcttttcttaaaaatagaccgggcacagtggctcacgcctgtaatcccagcactttggtaggctgaggtgggtggatcacgaggtcaagagaccgagaccatcctgaccaacatgatgaaaccccatccctactaaaaatacaaaacttagctgggcctagtggcgcacgcctgtagtcctcgctactccggaggctgaggcaggagaattgcttgaaacccgggaggcggaggttgcagtgagccgagatcgcgccactgcactccagcctggtgaaagagcaagactctgtctaaaaa

SEQ ID NO: 262868 - DNA, 525 bp, Homo sapiens
cttcctagccctacttgatattagctaaatctcttagagatggtttcaggaatctgtagtttttatatacagactatgtactcagacttatgcaattacatttggaaaattacagaatgagtatactgtggccaccccaatacaaggatcttctcctaatttcttaagtttttgcagtgacagctcatttatctgataaagaatgagcagtaatcctctctagtaattcaaatttgttgcagggacctgcaaactactgccacttgttttgtatagcaaggtagctcaggatggcttttacagtgtttaatgattcaaaaaaaataatgttttgtgatgtgaaaattgtatgaaattcaaatttcagtgtctgtaagtaaagttttattggaacatagccatacttattcatttacatattgtctttgtctgcttacatactgtagaggcagagatgagtagttgtagcagagaccacgtgattggcaaagcttaaattttttgcgacctgatactagacagaaa

SEQ ID NO: 262869 - DNA, 1200 bp, Homo sapiens
tttccacacatacagatgcatacacttgaggcagatgtagtagcattatatattgattgttttctttccacagaccatgcttgtgaaaataccaggacggtaaattagtgaattccaaagtcaggatttttgttggatctggcacagtcacaggaaagtctgagttttctcaagggcatccctgtctcaccgaggggcaccaaggacagacgaccagaagcaaatggcgcagtcaccgtcagaggagagtaaaactcattctgaaacggttccaaatgcccatgcctgctctgtggttttcagcaaagcggacctttccaaaagacctccaacagggacttcctggatgtgagaacactaaccaattctcgttcctctcatcttttgctttattccttccttccatgctgttattgcgaaaaactggtagttaaattcaattgattcaaaatattcgggatccatatggccgccaaccctggagctgaagcggcgatagcgcctcactgctgttttcaagcatttgcctctcctccagtccccagatggtgggagtaacatttaaacctccttttctctgccttgtacaatagaccttggcaccatttcaactgtttactccggtaattaacagctctgataccacaacaattacaactcctacactctcaccacaataatgctatgaattagtgagagctaatggctggaaggtagagtgtttccagactgtgggatctgtgcatttttagaataaaataaaaggtacaaacagcacgcttgcagtagaccatgattacctagtaattagtttacacaaagcttcctatttaatggcaaaacgctgtaattaacgtgtgacagaaaatcagagggtactttgtaagcatattaaaaattaacactgcaggcccatagctttatgtactgattagaagcatattaaatcaataggacacacaaaccaacagcttgggtagctgattattataggtcctcagaaggggtaccctggctttcatttcacttggggaggcaattttccttctcctgtcatcttcctcaggcacagagaaacacctcaaactcaaccctggcagcttcatgaaaataaccactgaactggaagaaaacattctaagtcattctcagagatgaagacaaatatgtaaatgattaagactttccatgattgtggtg

SEQ ID NO: 262870 - DNA, 437 bp, Homo sapiens
aatggattttaaaaggtgttatatgtacacaatggagtacttatcagccataataaagaatgaaatactgtcatttgtggcaatatggatgaacctggaggagaggacattatgttaagtgaaataagccaggtatagaaagaaaaattccacttgacctttctcatatgtgaaatctgaaaaagttgatcccataaaagcagagagtagactggtagctaccagaggatggggatatggagccatgggagggtttggaaaatgctggccaaatgatacaaaatgacagaaggaagaagttcaagaggtccattgtagagcatggcaattatagttaatggccatatattgtattcttgaaaaggaagtgatcagcaaacctaaaatactgatgaactgtaaaacttattatgaagagtcactctacatgacaagaa

SEQ ID NO: 262871 - DNA, 739 bp, Homo sapiens
gggagtttgggtgccagaggagttaggaagcttgatgctgttgttggccgtgactttggtgacagtgtgaccttggacaagttcctttatctctagggtctcagcatcttcatctgaagcatgaaaagtttggggtggtcccttccttctttaacctcccgagactctgtgcctctcacatgtatagattccctgtttgtagacagcagtgctgttatggggacctctgaaggctatctgaatgtgcctgcatttagcaagtcaaggccagaccctccagatgcactggactgtggggacattttgtgtgaatgagactattaagaatttagcagttcattctgacagcttgatagatggagtggttttgcatggcatccatgtaggaattgactaaaaaggaaacattttctgagagtccggctgtgtgtgcatgctgggaggtttttctcaaatcagattttaaaactttgctctgaaagaccaacaacaataacctaatccaatatccttgtatatttgattctactgaccataacatttcttaatttctgcttttggcttctgtagcctaatatactaatgataataagtattagtgttgtattaggaggtagatgctattatccctcttgcattcgttggagtctagttaggggatagaaaccatgctagttgagctgttctgcttatagagtagccattctttattcctttacttttttaataaacttgcctt

SEQ ID NO: 262872 - DNA, 916 bp, Homo sapiens
cctgggacccctccctcctccttgctgctcctaaaccacataggtcaggagtctggactgacccaggtacgtctggcatcttgcttgaggaacagggggttttgttttgttttgaaagaacgtctctgtctgttgcccaggctggagtgtagtggcatgatctcggctcactgcagccttaacctcctggctcaaacaagccccctgcctctgcctaccaagtagctgagactacaggcacctaccaccgtgcctgtctaatttttaaaattttttataaagatgaggtctctctttgttgcccaggctggtctcaaactcctaacctcaagcaatctgcccacgtcggcctcccaaagtgctgagattataggcgtgagccaccgtgcccaattgtgatcgtttttcccaaagaatgtatcacatgctaacaaaccatatatttatgtatttcattgttcatagtaactacaatttaaaaaactaaaaagaaacaagtgaggccgggtgcggttgctcatgcctgtaatcccagcactttgggaggccaaggtgggcagatcacctgaggtcgggagttcaagaccagcctgacaaacatggagaaacccgtctctactaaaaatacaaacttagccgggcatggtggcgcatgcctgtaatcccagctactccggaggctaaggcaggagaatggcttgaacccgggaggcgaagattgcggtgagcggagattgcgccattgcactccagcctgggcaacaagagtgaaacaccatctcaaaaataaataaataaataaaaagaaacaagtgaagttaacgttaataataatatatttgatttaacacaatgtatcccaaatattatcacttcaacatgtatccatattaaaaagttactgacatatttaaaa

SEQ ID NO: 262873 - DNA, 446 bp, Homo sapiens
acacacaggccgcctggaaaaagctctgcgttggacacagctgagcaccttaggcaccccggacggggctgaccctctgctggctcaggaggaagcacagagacgtgctccagtggcatttccgacttggatgaaagcaggaaagagctgaagcgtctggggagcctccaggaggtgacctcgggctgaaagtgccgatatgcaacagcctgctcccccggacctgagccaaggggctgctctgagcagggcagggtgggcctggaggggagccagggacccaagagacttccgagggccccaggagccaggaagcagcaccctggctccgcaaacgttagatcacaaagggcggctctgcggttccctgctttgactcctctgccaagagtgaaacagcacagcctcgaggtgttttagaagcttgttttgaaaaatgcaggcat

SEQ ID NO: 262874 - DNA, 225 bp, Homo sapiens
aaaaactttgtggaaagaagaattatcagggaactctaagctgaaaaattgccagggctcacacagacctggggaattggttgagtttatgccacctacaggatagagaacttgctgaatgttcaaggattttgttacagatgcaagatgacacttaaagggatgcaaaactaacatctctggattagtcttaataaagtttaaaaataagcttagaaaaagtca

SEQ ID NO: 262875 - DNA, 736 bp, Homo sapiens
aaaagccgaaaggagcattttttcctggtatagtttgcttcagaaatgtttttatttgtgctaataattggaattgctaataaaaagtaaactaagtctgctcactgtggattatactatgaaacagaataatcaatattatggtgctgatttaatattgtgaaaattggtattgtaaacattttccccatgatttctgttaataagtctgtctgaatttctttattctacagagctttctaggagcagcattgaggtttttttcacagaactttgagtagacctagcacaacagatgattgcttaggaaggcaaatgatatgacaggccaatctgtgatattactcttttggattaatattcatttcataagtccttgtactcttttttttttttaaccagtgttacttgccaatccttgagcttttgagtttctaatatattaggaataacatacatggaatgaggaatatgaacagcatttatctacatgtctgtaatactgtgttctgctacatgtcctgtgccttactaagcatttatatttttgtggactgtgggctgctccatcctcaactatcaaagttttaagaaaatatccacagccttttacctttgagaattacagagggtgcttacagacgtatcagcctgaggagaagaacccaacctgctacctacacgctggggctgcttaaaaattagggggcagtttttctatcagaaggaaaaaaaa

SEQ ID NO: 262876 - DNA, 1473 bp, Homo sapiens
aaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccagatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaata

SEQ ID NO: 262877 - DNA, 408 bp, Homo sapiens
gaagagaaaatgtaaggaacctaaaatagtgcttttcagacaataagcgttctgtaagccttggctatgttttaacattttgtaacagggaaataacatgtaaatcaggggaaaattgtacttttttccaaactttattaatctttatatatactatataaaatagacatacctacaatgatacaacagtcgcttttagtgtttaaatcaccaacagtaaacaaaggtacctttttgttatttggcaatctccgctgaatgaagagaatgcctcctctgccaccccagagatttatgaatgttgagtgtaatgacatatgagtgccaggatctaatgtttattgcacacatagtaaaaaggaaatgagtccaacgagatagactcagtctgaagagaaacaatagcaa

SEQ ID NO: 262878 - DNA, 1799 bp, Homo sapiens
aggcaggagacgtgctgcgggctgggctgcccgggggagatgactcctgccaggagggcgcctctgggaagaagaccacgggggaagcaaagtttcagggcagctgaggagccttcgccgcagcccttccgagcccaatcatcccccaggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtgggggggaggggagggcgggg

SEQ ID NO: 262879 - DNA, 418 bp, Homo sapiens
tagaattgtatttaaaggaaagatagcttttataaataaaggtagacttcttatagtttcggatttcttctgctttctcctgcaaaccattcccgtatttgatggtcactttctgcagcaatatgttttgatgttctctgctgggccggcacaacaataagtctcaataaggattttgtttatctataaataaaacccttagtatacagtacgagctaagacccaatcagacagcaggaggagcctggctttcttactgttggcctagttgaaatggtctttttttttttttttttgccactgttacaatttgccattgtcatcacaatcagattcactcaaggcagttcaattccatagatatttagagatctagatttactttatattacatccttagggcgtggctctgaccttc

SEQ ID NO: 262880 - DNA, 504 bp, Homo sapiens
tcagaagaaggtgtgacagctgcctccttgctaagagaaagacgtttcagtgtctgcctcctgggaatggagtctcctggtgactctgaggatggcgcaggactctcccagctaacactacacagaggctccccctcttcatgccacccctttgccagctgcagcctgtgtggacccagacacttctgacccaggctccagtgcccgcatgtctgatagcctgtatttcaaactctgggctctcctggacattccctctccagctgtatatgatgttatttttcagacccatttactgttgtccagtggcctgccaagacctttaggtgaagacgctgactccctcgccggctcttcttcattcttttcaaacacacaagagtgaaactccgtctcaaaataataataataataaataatgtacacttaaaaatggttaaatggcaaaatttgttatgtacattttactacaataaaacaaaaaaggtttcactttaaaaaaaa

SEQ ID NO: 262881 - DNA, 582 bp, Homo sapiens
gacattagccaaacggacaagaacaggtggactgaacacaaaagggaattctataaacacatttacaagattaggaagtattttttgtcttgttttaagagatctactgctatattgcacaggctggcctgcctcagcaacatagtaacgcatctactggctcaagcaatcttcccacctcaggtctcaagtagctgggactacaggaatgcgcctccgtgcccggctaaggtttcgagttttgctactatattttgtcattcttgtatctaattacaagaaatttattagtaaatataggtaaatattattaggaacactaataccattccgatgttcatcacgtgtttctctgtatagcactaactaagcagcagggggaaaaatgcattaatcgctgctttgtatgtcacgcttgaatattataaaaatctttgttaaaaagaaaaatacatgcctccaatatcccagagggcttaacgggtttatggcttacttcctagtttgagaaatgttggcctgaaaaactaaattattattcttttaaaatgtgtttccacaggaagttaccattaaaaatga

SEQ ID NO: 262882 - DNA, 663 bp, Homo sapiens
cccatttaaaattgttattattttccaatattttgtgtctatttttattttttatatacttttcaaaatcagttgtttagtatcagtatcattagataaataggcaattgtgtgtcagaagtatatacagatagattttgttacattttaattaaatactaatttctctctcacacacgcactccatttaactattcagttctttatttatcttattcttagtagctgctttaactaaagaaaaataaacttgagtcaggctagacagtacagggaatggaggagacaggtagtgaggggatactcataaatcttcatagatatcaacttacccacacttggcaaagtggctgtgtgcacatatttgacctcttcacttttcagacaagttgaaccattttcgggccagggagtacaaagaatgatgcagttatctgaaaagttgtttctacagtgatttctctttaatctcccctacttccctcataatgcctgcagtttttgtgttttctacataaaaggaattaaacagaaaaattgctaaaaataagctggttactgtttcatgacttccagccaccaatggcaattagaaaaacaaatattccttccttggaatcacttgagttcgtaaatttgtaaaccatacagctcttgaatttt

SEQ ID NO: 262883 - DNA, 978 bp, Homo sapiens
ttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaagaaaaacaaaaaaaaaaaaaaaaaaaaaaaaaaaaaaaaaaggggcgcggcgccgtctctcaagaagttttccctctccgcgaggggcccccagagctttgcgcgggttacaccgcggtttttctttgttcccagaggggggccccctatatggggaggccgcgctttttataagcgcccgtgggcccggggcgccggcgggtttaacaaccggtgtcgtggagcgcgggtgcgaaaaacctgtggtaacacgtgggggaacaccttcggagaaggagagacccctataacctccgggggggggggggcgaccactttgttcgggcacccaatacttcccctctagacaagagacgttttaaacgcgccccagagggg

SEQ ID NO: 262884 - DNA, 430 bp, Homo sapiens
ataagaacagcacaggaaacagccatccctatgattcaattacttcccactgggtccctcctatgacacatggggattatgagagctacaattcaagatgagattctggtggggacacagccaaatcatatcaggtgaatttctcaagattgcatttggttcccactcataattgagacatgagtgagacatgagtacaggacacatttcataatccatttatttcaactataaggaaaacaacagtataagcacaataataaatggtaagtagagatctcattatgaagagacaacagagagcggtggggactgtggcaaactggagggtaattgctcagtatagggtggtagctactacttacttcttcctgattgttgatgaaggagattttaagtctaatgttattagatattcttaccttttagg

SEQ ID NO: 262885 - DNA, 412 bp, Homo sapiens
actaggctcatactcaactgatgattattagacaattccatttctttctggttattataaacagaaaatctttcctcttctcattgccagtaaaggctcttggtatctttctgttggaatgatttctatgaacttgtcttattttaatggtgggttttttttctggtaagatttggatccaagtcgcatcatgcccacttgtgactttgagattattcatcaagaatgaggatatagtagccatgacatagcttgagctatagcctttaatcccttacttcggctgtggggggagggtgagtttgaaaatgttctgattttcttgtaacctgggaaagccatgaccttgtgcccgattctttcagattgctttgggtaataaatattggtggtggtatctgactcatgctgc

SEQ ID NO: 262886 - DNA, 356 bp, Homo sapiens
agctcactttatctctcgactacttaggaattcaaggaagagcagtgacaggacttttgacggaggtattttagaggctgtgggccatcctcaactcttacaaatttcccacaataagaatacacattgcatttaaaatcccctattttgaggcttgaagcttcccacctatgggttcatgtaaggatggaagtgggtttcagggcttctgctcagggacttggggtgatcatttctgtctaatcccatcaggaacaatgacttaccttggtgtatgctctctgtgtgtgtgtgtgtgtgtgtgtgtgtgtgtgtgtgtgtgtgacagagagagagagagagagagagagagaaag

SEQ ID NO: 262887 - DNA, 634 bp, Homo sapiens
tctgtcaactcttatagttaatttttcagtaagtcctgtttctgctttcataatatttctccagtccatccacttttactgtcatcaccttcatcaggccactccatcgttatccagttatgtatgaacacctgctttgcattctattttccacttctgctaacagtgtttcaccattgttactattaatcttaggttgtgaagtgctgataaagacagtgtcaggactctgcttattacatctataaattcacactatccaagctcagttagactgacattactatttagcagaccatcttcctcctgcttgaaatatccttgcgttctcatgtattactcctatccccattcctggtttatgtgtagtggaattaagagtggagctttttagcatacatgttttttttttttttcatcttttttctttatttccccacctccttatattgagttagataaaaaatgggaattctacatctgatctgactaatataaactgctgtcaaggtgaccttataaaatatatttatgtactatctctgctgtatattcaatggatctttttccaaccaaatgaactatgaaaacttcatcctggccctccaggctgccttttaaggtgttgccaatt

SEQ ID NO: 262888 - DNA, 1788 bp, Homo sapiens
aggaggaacacttccactaaaagaaacatcaagattactatgaactattagctgtgactgcacccgggcacttgagctcctcatatcaggagactactaggcaagaacagtcaccattctttgagggataattaatcctgatcatcaggaggaggtacagctgctgttaagcaatggagggaagggaggtatatctttggtactcagttgattcacgtggagacttcttggtattcctttgcccaatttttttttctttttctttttcagaggtggagtctctgtcacccaggctggagtgcagtggcaccatctcggctcactgcaacctctgcctcctgggttcaagctattctcctgcctcagcctcccgagtaactgggattacaggcatgtgccaccatgcccagctgatttttgtatttttagtaaagatggagtttcgccatgttggccagactagttttgaacttctggcctcaagcagtccacctgcctcagcttcccaaagtgctgggattacaggcgtgagccactgcgcctggccccttgcccaatatttataaaataattatacaagtgcccagaccgtgacctgagcaggatatgctgacttcaggctcagccccctcagggctgagggtctaaatcatgcctccgtggaagtgacggagaccggaacacgtgctggctgagggtaaggaggatctagaatggatagtagaagagggagatgatgagtatcagttgtggcctcaagaccagtcagtgatggaggttgtagtttgtccaacttactttcctaagtttcccccaggaaaggaggtccaccagaacttaaaccaaaaagtagagctgagcagcacaaatgtgggctgtagtggacaccatcctgtgctgcccagaccccccagccaccatgcttcctgggcctcttcccacagctactgggagtgctctcagccagcagccttcagctgtcagccccctgggaattttcctcaatggaagagttacctcactgacatacccctttcccaggcaggtcagttcaaggttatgaaggcctggccccactgcctcaacttgacaacttggaagggccatctcagcttcaagaccctcccatgagactggctgaggtcttcatacagcatcggagcccaatttatctctctgagcaatcctgcttcctttcctgcccccttcccaagagcaatccctgataaacttcccgcatgctaatctccatctcagagtctactttccaaggaagtgggcctataacatagctcttccagtttttgttaacaattctagaacaggggtcagcaaactttttttttttttcttttgagacggagtctcactccgtcaccaggctggagtgcagtggcgcgatcttggctcactgcaacctctgcctcccgggttcaagcgattctcctgcctcagcctcccgagtagctgggactaccatgccaccacacccagctaatttttttatttttagagagattgggtttcaccatgttggccaggatggtcttgatctcttgacctcgtgatccgcgctcctcggcctcccaaagtgctgggattatagacatgaatccccacacccggccagcaaacttttttaaaggaacagatagtaaatattttaagctttgtgagccacatggtctctgtcacaactattcagctctgctattgtaatacaaaagcagctgtggacagtatgtaaatgaatgaatgtggctgtgttccaataaaactttatttccc

SEQ ID NO: 262889 - DNA, 429 bp, Homo sapiens
ctagggcaaaacaggcaatggcactgggtcctggagacgctgccctgaagcctgcagtatgctgaacttatgctctcagcatctgtccactttcacctaagctgcgtttccactggtttgctgctgaatctactcctgactgaaaccttccaatgtgcatggggccagggtgggagaagccttcagctctagcgatgggaatgatcaccacagggcagggaaactggcccagggcctgcagcctttgcttctcagactggctggggttccatctgcagggtcctacaccctcatcacctgctgcttgtgaacacgagaacaggaaagtcttgaaaaatctgaatttccaggtgaaatcttctagttttaaaactaggaaatggtttcctaggtgtaaaggagttttacaaagacatcctgaggcagaat

SEQ ID NO: 262890 - DNA, 496 bp, Homo sapiens
gtaaactacggtttgcaatgaacgcggctcctaattttcttaattaaatcttatttacccaatttcgttgaatgaaggtttatgctaaagggtggctttttattttaatctaaaaaaattggcttcagaactgtattttatgcagacattggaaagttgagcaactgcctgctggaagtgttgagtgtagccagagataattcggacaaaaatcttcgttttgttaagtacaggcatttttggttagatttgatattccacaatgtcatgtttaatgtttattgaaaagaatcatgattatgtcaaaataacttagctttaatggtctgaaataggatttttcttaccaggactagcagaaggcctaagaggagagttttctttgttactgatgaacagtatggtgacagtctttgaattgtagcaatgggcttctggttatacaaaaaatgtttatatattttaagctctgtaattttaagttatggcccttaag

SEQ ID NO: 262891 - DNA, 470 bp, Homo sapiens
cctgggtctgtgtgctctgtccctgactccgggtaccctgcctctgtctctttctccaagactctgtttcttcctttctgtgtcggtgcctctgtgttgatgagggtgtatgtgttcctctctcagtaaaagggccctgttcccctagtaattataaccacttctttctgtggaccccacatttccccaatttggagctgaacttatttatttatttatttacttatgtattttgagacagggtctccagcctgggggacagagtgagaccctgtctgaaagaaagagagaaagaaagaaagagagagagagaaagaaagaaagaaagcaagaaagaaagaaagaaagaaagaaagaaagggaaagatggaaggaaggaaggaaaaagaaagagaaagagagagagagagaaagaaaaagaaagaaaagtaagaaagaaaaaagcccaagaaagaaaagtaagaaagaaa

SEQ ID NO: 262892 - DNA, 383 bp, Homo sapiens
gaggtggctgcagaagagcctgcagctctgaggatgagaattcagggagtttgtgaaatagaagctgctatagattgaatgtttgtgaacaccagcccaactaccaaaattcttatgctgaagccttaattaatccacagtgtgagacattgcaaggtggagcctttgggaggtcatcagggtggagccctcataaggagattggtgcccttataagaagaagaaaccagagccctctcttgctctgccaggtgaggacacagtgagaagaaggccatctgcaagcaggaatgggtcctcactaggaatcaaatctgctggcaccttgatcttgaacttcccagcttccagaactgtgagaaataaatgtctgtttttaagct

SEQ ID NO: 262893 - DNA, 371 bp, Homo sapiens
gtattaagacaaaatatgttctttcctcctgcctttcagaacttctgtcatgtggccatattgccttctacattgaaacaatcacacaaaacccaggatggcagaaagtcaaaattttagttcccttcttacatgccgttttccctatgtcaggaccctggagagggggtggtttggcatcgggcagatttgtgtttgaattctggctcctgttacttacatgccttaaacagaacactctcctgagcttgattctcactctgtaaagtggggataataatgccttctttgtagggctcagaatagtatgtgaaatgtatctgtcacggtgcctggtacaaagtaaggctgttgttattaccattattctt

SEQ ID NO: 262894 - DNA, 373 bp, Homo sapiens
aatgtttatttgattctgtaatgagtgtaagacaaggggaaggtacaatacaattcttatctagagtaaggctgacacaggacttatacattgcctcccatcacactcccacaaatgtatacatgctcaaatatttgaataggcacaggtttttgaagcttcccctctccaagcctttcaatgataaacctctgcattttattcccctgggacttctgttggctacaaaagctgggggcaaccagaaccttaacaattgtatatttctgcaagatatatccctatttgaaattgtgccatggagggcttgcccaaaggtgggaagctggagaaattcctggtctttgtctcactggttagggaagccattcat

SEQ ID NO: 262895 - DNA, 700 bp, Homo sapiens
tgcaaagtatgccacaatccaattttaactttcttcagaatcccaattttaagtgggagtagaaggcccaccttaacagtagtaagaacattcataaagactaaaatagaaccttgctcaaaataacttgcacccactaggtcaaacaggcagctcaaatttctgcaatctgaaccttgctctcaatattatgctcactcaagtcaatgttatagtagaagtatgtgctattttcacacagctatctcaaatgtaaacaagatcatttaaaagccagaagagagctccattagtctaattaaactattctgtgtttactccttcataaaacaaaagactaatccttaacttgtatagaggtttatacaaaataagctcaatgaagtcctagactggttaagatgctttggaaaagacaagaactcctacagcaggaacgcattctggtggcagagaccgtgaaatgtatatgaccttcagtatacttaaaagacaagcagacatctgcacatatacatagaaccacttctagaaatctacaggaagaaaataatccaaacactgaaagttagcctaaagctaagagacagagacagaaacatacaagtgctcaatacaaataatcattgactatccaaccacaggtattcaagcaatcatttacaatgtttataaagtttttatttacaaggaaaaataa

SEQ ID NO: 262896 - DNA, 209 bp, Homo sapiens
ctggttctggcattacggtaatttgtcattgtctacagctctcaaattttgggaaatttgggtctgtcacctgtcctgaaattactgtaagttgggttcatttgtaaccctcaagttttggtaccgtaaaggttgatttccagcctgagattatggtaatttggcctgtttgtttcctggggtgcctgctcagacagccagacagactc

SEQ ID NO: 262897 - DNA, 1427 bp, Homo sapiens
aggcgcagaccggatggaagccggggccactggcagcctgtaactggttcccctgggaaggccgctctggtgatgaactcagctcctcacctggggcctggcagtccgatcacggaaacgagaattgcgaccccgtggctcatctggggtgctgcggctctgtaatcgtgtgggtttccgtcatctttgggggcaggaacgggcagcgagtggccgcttggattaaccacccccacctctgggcgcggctggcaccttgtaattaggtcactcgtaggtggaggagcgtgtacctaccgggggagtgctgcgcagtgcacctgacttccgcggcacacacccgtccccggacctaggtgtctcgtcgggcgcgatggcgggggcgaggcttgggcttttctttgggcctcggaccgcggctcgcttccacgcgccccgctcctcgccggtggttgctttcctccaagtttaattctctctgggaatgagagaccctcaacccctgcgcgccctggcctactttcaagaggggaagcccagagaagatggatgcacctgtcctgaccgcgtctcggtggcgtgagaagcagctgtgatacgtgcttaaaagagagagctcgtataccctaggattggacctctgtctggttatgaatcgctttggagtttgcgaaacgttttcacattccattgtccctgcttttacataaatatctggttccatagagcgccagtattatgccagatccggaggggtcatccagacggaccagggaccatgccctggagcttgtattctcccaacagtactggctgaagatggtttgggataggcagaagagagatcataatgcccccaggatttgaaagatatagaagctttccaaagaacatttaaccataaagggcaaggcaagagctgaacctgatcgcctgtcttccaggaaccccaccctcagtatcaggcaacccttccacacccaagtgctcagcgatgcttgggaggagactgctcactctgcggctctgagggcatcatccccaccaacaggctgaagaaggcactggaggccccatcagccaatagcaggactgaaaatcctcctttatccaagacaacgtgtttggcaaggccgactggcttggcctccctaggctggaaattgcaattctgctttcccttcacacctcccattagtgtgcacaaaagaaagtaccttagatctactcttctagaagtcttatcacatacttaatttaccagactgggaaaaagaccctttagcccaaattctgtccctgttttgcagttaacatccccaaacaatagaagggtaagagttaagaccaagtggaatgaataaggaaaaaatcatcacttagtgcccgtgattataaagccatacccagtgtgcagtctaatctta

SEQ ID NO: 262898 - DNA, 1172 bp, Homo sapiens
aaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggagcgcccaagctttcggttctgagctcggactaagccatgtggattcaggtgtggatgacggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaaaaaaaaa

SEQ ID NO: 262899 - DNA, 723 bp, Homo sapiens
atgggcctctactgagcatttgaggggccgagtttgaagcggttgctgcttcctttcagtgacttggttatgtcctcagtagcttgcggttatgaaaggcctagaggttttgttcgatttgaagctgtcattgagctgtaatgattcatcggaagaaaaaggacaaaacaacctccaagaaacctctaccaacctccgagaaatcatcctcccgctcgggagtactactgtcttcgctccgggcccataacacttgggggtgacaattctgaaactatacctggtatctggttcttacttcagggccataaaactaagatcgcccacactctccccttaaataagacatctcgatggactagtgactaccatccttttttttggtgtgagctacagagctgagcctttggtctcttgtagcagttgctgctttaggcaaagctcgagcttccttgctgtattaaaaagagtggaaatgaagttagtaaacttttttgtgcccatataatatttcagttgtatctagggttaaatgggctgtagtataggtgaggaaaagatttctggaataagacgttgctcttttacctttaagaaaggatctggggccgggcaccgtggctcagcctgtaatcccagcactttgggaggccgaggcaggcggatcacgaggtcaggagatcgagaccatcctggctagcacagtgaaaccccgtctctact

SEQ ID NO: 262900 - DNA, 275 bp, Homo sapiens
atgggcctctactgagcatttgaggggccgagtttgaagcggttgctgcttcctttcagtgacttggttatgtcctcagtagcttgcggttatgaaaggcctagaggttttgttcgatttgaagctgtcattgagctgtaatgattcatcggaagaaaaaggacaaaacaacctccaagaaacctctaccaacctccgagaaatcatccagcctgggccatagagcgagactccgtctccctccagcctgggccacagagcgagactccgtctca

SEQ ID NO: 262901 - DNA, 386 bp, Homo sapiens
agaagttctctgcctgtgataaaatgagaatctgaattaccagatttagctttgattatcaggttttaaggttcctttaagatctaaaaatctatatactggccgggtgtggcggctcacacctgtaatcccagcactttgggaggccgaggcggacggatcacaaggtcaggcgattgagactatcctggccaacactgtgaaaccctgtctctactaaaaatacaaaaattaaccgggtgtggtggcgcgcacctgtggtcacagccactccagaatagtaggcaggccaatcgcttaaacctgggaggcagaggttgcagtgagctgagatcacgccactgcactccagcctggtgatagagcaaaactccgtctcaaaaaaa

SEQ ID NO: 262902 - DNA, 669 bp, Homo sapiens
gagacactttcaggagtgcataatggaaggcttatgtagaactaggaccaagcctctcaattacactaagttgtccatgattgaccagagatttgatggaaaccccactgccttcctggagaagataagagaggccctggtaaagcatacctctctctctcctgattcagtcgagggacaactaatcctaaaggataaatttattacccaggcagctcctgacatcaagaggaagctacaaaaacaggccctggaaccagacagtagtttagagaacctccttaaactagccacctcagtcttttataatagagacagggaggcccaggaatgagagaggaaatacagtaaagagacagaagctttaaaggccaccaagcaagctcacaaaccccagaattctcagtgtgcacctgttaactgctaaagatatggcaagaacagttatttcattctaaaagtttatccactcccatgcaaggtttaatgtgtttcacctgggtgaaacagcgcagggttcaatgttgttagtatattttactgcttgtctctgtaatctttggcactaaattctttttttgtatcatacacatatttagcccatacatacttaaccttataaaacttgtttttttcctcttacgcctagaagccatcaaattccaaagg

SEQ ID NO: 262903 - DNA, 430 bp, Homo sapiens
cagctgcccccccagcgggcacagcacctcctccctgtgtgatggggtggggcccacagtctcctttctcgcggcctgcctgggctgaccctgggtcccagctcggccatggggcttcggcatgtaaagcccttggggggcagagcctcccacccccgccagcttctggctctctgtgtcgcccccagcactggactggtgccttggagggaggctccgctctcctccacatcaacccgctgaggagttctgtcttcccagggttgtgagagaaatcagctctgcaggcctatgtccaagtctaggcgccgcctcctccagggagccttccagacctgatctgtgtggcagaggcccagaaggacctgggtgtggggatcctagagggaggcgggggacccagcgtgaggagagagggtcccagtgcttc

SEQ ID NO: 262904 - DNA, 411 bp, Homo sapiens
cacagcattcatcccatttggaggaagcagtgttcaaggcaccatcctggaagcagagactgggccatcaccaggcaccaaaccagctggcaccttggtcttagacttcccaacccccagaactgttcccagtgctacaatgggatatttataaagatggggaaccagcggggtgccatggctcacacttgtaatcccaaaactttgggaggcccagaatattgctgctgccaaccactgatttaggaatgtttagaggtatatgccaactcaataatcaaaatcattttggtactgggaacccaaccacagtctctgtagaccagtggaatttattgcttgctccagtttattaagtaagagtaccaacagcattttgaataaaaaagagtctgataagatgtgatagaa

SEQ ID NO: 262905 - DNA, 360 bp, Homo sapiens
gagtctggaaatgacccctctatccaggaaggggctctggagtctccagttcattattccggacagagttgctggtgccacgacttatctcctgcgtgtggagaattccttggctggtacccacctcctctcagccccagcacagccctggcccctaaggcgcgtggctgattgggattccccagcggcttgaacagaaataagtctctatcctggagttaggagtagtgaaattagcacgacttcacatctgttatagcatattagggagggcttacgtgaactgggaatacagcaaattatatttgtatccaacgaaagaggaagaataaatcactaccagaacagtataggtttgcc

SEQ ID NO: 262906 - DNA, 184 bp, Homo sapiens
ttgcaatgagctgtgggtccaggagttggggcggcaggctgtcgtggcctgtcctaggtgactgggaaaagtgacctgcagaaaaacaaaggaacctgcctacccctgggccagcagcctgtgggtctcaactgctcagggccttccccactaattaataaatatttgactttcccattatgga

SEQ ID NO: 262907 - DNA, 936 bp, Homo sapiens
atggctacttcaaaccattcttcaggggctgagtttatcctggcaggcttgacacaacgcccagaacttcaactgccactcttcctcctgttccttggaatatatgtggtcacagtggtggggaacctgggcatgatcttcttaattgctctcagttctcaactttaccctccagtgtattattttctcagtcatttgtctttcattgatctctgctactcctctgtcattacccctaagatgctggtgaactttgttccagaggagaacattatctcctttctggaatgcattactcaactttatttcttccttatttttgtaattgcagaaggctaccttctgacagccatggaatatgaccgttatgttgctatctgtcgcccactgctttacaatattgtcatgtcccacagggtctgttccataatgatggctgtggtatactcactgggttttctgtgggccacagtccatactacccgcatgtcagtgttgtcattctgtaggtctcatacggtcagtcattatttttgtgatattctccccttattgactctgtcttgctccagcacccacatcaatgagattctgctgttcattattggaggagttaataccttagcaactacactggcggtccttatctcttatgctttcattttctctagtatccttggtattcattccactgaggggcaatccaaagcctttggcacttgtagctcccatctcttggctgtgggcatcttttttgggtctataacattcatgtatttcaagcccccttccagcactactatggaaaaagagaaggtgtcttctgtgttctacatcacaataatccccatgctgaatcctctaatctatagcctgaggaacaaggatgtgaaaaatgcactgaagaagatgactaggggaaggcagtcatcctga

SEQ ID NO: 262908 - DNA, 522 bp, Homo sapiens
ctgagtacaaggagttagcgatagggaagagaaaggaagaactctctgtttttgacataagcatctgagtaaatggaggtaccattcactaacatggacaaaaatcaaagatgagcagctctctatgagcagaagcaaagcaggggcacacagagtggtataatgaacatcggagagtcagaagtgaggcagatgggaggggagaaatgaaaaattacctattgggtacaacgtacactattccagtgacaggtatactaaaagcccacacttcaccactctacaattcatccatgtaaccaaaatcacttttacccctaaatctatcaaaattggaaccaagaggtgatgtcaagtaagacaatacatgaataggtttgaagcgcaaaagagatctatatgtcagctagatgtatacgtttgagaattgttggcatattcatagcactgaaaactataaaaataaataaggtatccaaaggcacagcttgaaatgagaaaacaggatgaagccctgggaac

SEQ ID NO: 262909 - DNA, 545 bp, Homo sapiens
aacattttctgatttgaaatacagacaataaaatattgttttcttactgcagcggatctgacatagcacctgtacatgcatgtttaggttttgtaatagaaatatgacagaaaagatgctgagtaggaagctatgaaaaatactcaaaagccaacctctttatggtaacctcctagcttgtttaaattaccatgcctacctcttctccagccttgttcattttctcagccacttccttttcctgaactttgattctgatttgatgcatgcatatactgaaaaaagtttgccaccagtttgggggtttcggggggtcaactagattctatgtttaattctcagtcccatttccctggcttcaactacaattcctctagatgataatgctggatactgaccccgactatagggccctttccacaagtgactgcaaacactctcccaattccaattccaagccaaccttcatgctctcctacctctataccttaggtagtgcatccaccaggcttcttcttgcattaaaataccattctttatatctt

SEQ ID NO: 262910 - DNA, 357 bp, Homo sapiens
tagcttaataaaagtgtcgacagaaaaacattgaaatggaaagtgtaaaaacataagtgatacactggtgctcaaatttcaatatatgatcaaaaaagagtatatgtaaaaaaattatcctaaagctcaaaggcaaacaaatgaaaatcccatataattaatcagaaaaaaatgctactatgattctgaattaaaatgcaacagaaaacgacatatccaagaatattttggtttgaagacaaaaattctgaggtgcagattgtggacagtgatttctaatttcacttaaattatgaatattaaagaagcaaagagattaaaataagaaacacaataaaatgaaaatatgtaattttg

SEQ ID NO: 262911 - DNA, 457 bp, Homo sapiens
gttactctcctggctccctctaaaccccactcagagaggaacgcttcctcttcctcttgttaagtgacatcaacacattgaaatacagctcttggctaaactccgcgagctgactttgaaaggtaacgggaagaaacatttcctttcaaaaggaatctggcagcctttgagcctttgaaacacacccatttcagatgagtctgagttgggcaggaattgcaagtacttccaaaatcatccgtgtcaatatttcccccacccctggaatattaatatgtacacacacccacacactccccttgagatgtgtttatttcacaattcacaaatggtgaagagaccttttctgaatttttttcttagggacttgggaagccagcatgaaaattgtgattcttccaaatgctttcccatatgccttaaatgcccccattaaagttaattttctcagtccaca

SEQ ID NO: 262912 - DNA, 426 bp, Homo sapiens
gatgaggttgatgggctgcaccataaccttctgcactttctggccctggctgtggtacaccatggtggaatcccacagaaagcacactgacccacacgctacctcagccagcaacttctggaataaaaaaccgaaaatgggctgggcatggtggctcacacctgtaatctcagcactatgggaggccgaggcaggcagatggcttgaggccaggagttcgagaccagcctggccaacatggcgaaaccccctctctactaaaatacaaaaaaatagctggttgtgatggttcacgcctgtaatcccagctacccagctacttgagagtctgaggtgggaggatagtttgaacccaggaggcagagtctgcagtgagctgagatcatgccatggcactccaacctgagcaacagagtaagactctgt

SEQ ID NO: 262913 - DNA, 142 bp, Homo sapiens
gatgcagccatcctttctctttcttctctctcatttcccacccaccccccactctctctttctctcctccccgtcagtctgtctttactcttcttttcctccattttttttttgtagtacaactgaagaaaactgaacctca

SEQ ID NO: 262914 - DNA, 321 bp, Homo sapiens
gacttcagaatggacaggaatcagagcaaccctggaaatcctggtgtcaggacctaatgaagaagctctagagggagctgcccttgggataatgggacctagatgattctttgcatctgttccaggattcaagcaaagggagggtgttttcagttgctccagctttgaacagggaaggacaggcaccatgattgactcttgccagacataaatccaatgagaggcagtggtttctcccaaagtaaaatcagagtgctctagctagaatagatactggcaggcaaaaatgatagatatccatgatggccccactgactagag

SEQ ID NO: 262915 - DNA, 172 bp, Homo sapiens
tatgcccagtctgagttctcaatgaagaccaaaaatagttcttggtgctatgctgtctctagttccacaaccttcatacaaaacacaaacccctcgctggtttaagagtgccagaaagcactggggagttagggccaatcatgtgccgtgagcaacttgtactcataaacca

SEQ ID NO: 262916 - DNA, 675 bp, Homo sapiens
cagacattaagcagcagagcaacttagcaagagaagacagatcctcaggttggtgggcaatgtctgaacagtctgctcatggcaccaattgttagtcacttgcaaagatgtggctttaagagggtaagaaattactactcacataaattacatttgtgaggtaagtaggaaggcctttcaaggtgatctgacatggcttgaatgtgcaagaaaaggagccaggcctggatttttattgagggtaggtggcatgctagggtgagaatttattcccatggacaggggtttgaatggtttcaatctgctgctggtaccagaaaagggaccacccaggtttcctcttactgtattattttatacacacacacacacacacacacacacacacacacacacacacacacggtttaggattaaaaatagagacaaccatcaaaaagtgaagatagttccttttggtcagcctggcaagtaaggacgtagaaggtgacattcgcatcagcgaaagtaaaaagggaaacataggccagcaattctcctaacatctatcagaaaaataagttcacagggcaaatcaccatcccaaattggacagaaggacacacacatccagagaattataacttacttggttagtaaaccacaagaaacccctatgggaacaaatacagttgt

SEQ ID NO: 262917 - DNA, 481 bp, Homo sapiens
gcttaaactttattcacttggagtagaacttcctagttaaatgattgaaaaggactagttctgcaaaatctatgagaacaagagcttctgcaaatgcataatataaattctcttcctttttttttttaaactgtatttttacaaacctagatctcttcctgctttgatttgtctttatcatatctttcagaacaaacctttgatggaattctaggaaaggttgagattaagaatatattaaaaatattccactttgtacattctgtttatattatagtaaactaagttatttagcaagataaaattaggaatttcacccaaggtatcaatcagatggaaccattagtccactgaagaatttactttttaaaaaagttagtggaggaaaggagaagatgctgcttaagagtaatcagaaataaagatggtaagcatcatatggtaaatatatacaagtttcatcaattttgtaaaaaaaaaa

SEQ ID NO: 262918 - DNA, 488 bp, Homo sapiens
cggttgtctgctcagtaacctagcgaagcccgcgactgccctgcctggtggagacgggcgcgcccctccctcaagctggtcgaggaggtgctaacacaggacttcgtcaatgaagcaagacctccctacatgcttaggtctgaatccagctattccagatctttccactcacactaagtaggctgaacagcttcagactctcccctaagatcacagccaaggactgggccggatcgctccagtgtgacacggagccggtggccatgcctggggcatccaatgccctgaacggagccgcacgcaccacctccccccaggctagggcagccgccccggggctgcgggatgctgggaagccattaatgagggagtagatctggtgaggagatgagggagggcaggagagcagcaggcccccatgcagggagaggaagccgcacgcctgacgctctggcgggacgaccgcggcctctgaagagcgcggccgc

SEQ ID NO: 262919 - DNA, 170 bp, Homo sapiens
caaggcaaagaaatgaaaggcatccaaataggaaaggaaggggtgagattgtctctgttttctgaaaatgtaatcctaatgtaaagaaaatcttagactccaccgaaaaaacctgttaaagctgataaacacattcaataaagttgagagttacaaaattaacatacaaa

SEQ ID NO: 262920 - DNA, 688 bp, Homo sapiens
gccaggcatagtggtacacacctgtaatcctagctactcgggaggctgaaacaggaaaattgcttaaacctgggaggcggaggttgcagtgagccaagatcacaccactgcactgcagcctgggcaacagagtgagactccttctcaaataaataaataaataaataaataaataaataaataaataaagtagattaatggttgaaagaggataggggcaagagagaatgaggagtgactactgagaaatatgagactctcttgaggatgataaaaatgttccgtgattagagagtggtgatgggtgtataactgtgaatatattataattcattgaattataatttttaaaaaggtgaatattaatattaaaatgatgaaagaggtagtactggctagattcccagggaaaccacaagtgtaggagagcagctatgacctatagtaggactagtcatcaatccatggtgtgacagggaaagaataaatagtaagtcctttcctcctctgtcttatctcatgccaatgttcccaatcagttaacttcaaccagaatctggaattgaaaagacccttaaagatgcagtcaggcttccagacatggagaaggaacagaagtgtagtacttagacacggaaaggaaattgagaatatctacaccaactctcaaagtctggatagtcttcac

SEQ ID NO: 262921 - DNA, 486 bp, Homo sapiens
gaactttctgaagaagtaatgggaatactctgtatctgtgatgtcctgtatggtagccactggcctcacacagctcttgagcacttgaaatgtggctactgtgactgagtaattgagttttaaaatttcatcaattttaattaattgaaatttaaatagccacatgaggccagtgactacagaattgaacagcacaggtctcacagatggactaagagtaagccagttacgaagaagcttatacaggaagaccggctaaaatatgtcaaaggagagtttctctttctgaactccgaggagctgttcaaacaagactggtctggagagagttttgggtggctggaggtattttcacccctccacttactgtgcctaaccttagtattgttgccattctcacgtttctgtatgactccatctcccttgttctgttccgatgccgctttttcagtttttctgagctctcaattaaacacagtgaaatga

SEQ ID NO: 262922 - DNA, 562 bp, Homo sapiens
tccttttatgacttctcagtatttagaatagaatccaaactctttaccctgtctcgtatgaaaaagcccagtagaatctgccccagcctacaccttcaagaccatcttgcatctttcataccatgctctaaccatactggcctccttttcgtttctgcaacatgcatagctcatttctcctctgcacgaattgatttttttcaactgaaaaactaattgtgcttgacagattgtcttgtcattcttatctaacctaaaatttcacccctttcaagagacccttcccgactatcaaatacaaagtacttatacagtgatttcgtaagaccaaattttaattatttgcaaagaactcatcaacctgtgttttgtttggtttttgttcatttgttttaataaattgctgtatccaccaaaccactgaactgtgagcttcacaggagtaggaatattaactgtccattactgtatcttttgcctggtaagcaactgaaaagtactttggaagggtgagagaaaagaaagagagaggagagagaggggaaggagaaagattattttc

SEQ ID NO: 262923 - DNA, 633 bp, Homo sapiens
ccaaaaccttggcctaatctgcctgggggccagactcagacagccaagccaggcttcttagaaattgtagctctcttccttttaccctcttgagagaaaaaaaataaaataaaatctgcagattctttaaggcagtttagctcaagtatccaacaactggttttttgttttttaatgaagtcaacaaagtagactaagaggaagtaggataggaacaaaacaagggaaaataattttagaatattatggaagatagaagtaaaaaggacatcccaaatctatcagcttggtgtaagaatttggttaatgaaaggttaatgtggcatttacctttgagagtttggaagttcaaacccaacccaaagacctttctatgtgaagtaaatctgatggctacaaaataaatattaacagatttctcctcaaactgcttatttgtcactaactgacttctttatattataaaacaaaagagaaaggtgagaggttaaatggggtagggggatgctaccatcttcacaattgaagctacatgcatcaatatgtagcagccttgaactatcatggttctatttttgcttggcttccaggaagctcagagctaagagcatgctcagtaattattttatatct

SEQ ID NO: 262924 - DNA, 337 bp, Homo sapiens
ccagttacccgccctgtctacggcccaaacggccatgctagtgaaaacctgccctggccgctaagcaagcctagcccaggctgtaacccatgtttctagggcttgttttcctctgcagtcaaatcagagattcggagttgaaggggatcttagaggtcaacatgcccaacctcttagcccgagtgagtgaatgtacgctttttacctgcacaccccgaaaatcgcccgttttctggaaacaacgttgattatgtagtcctggaactttcctgcatgcacattttattccttcgacaatatttattgctacctactgtgtgcaggcattgtaggcccc

SEQ ID NO: 262925 - DNA, 447 bp, Homo sapiens
ctgaagatggcaatgagcaaagaacgaacgaacttgggtccttcaagattactttgagacactgaataaaccaagtctggagctacccattgctggggatttttattacgtgaggtcataaaatccccattgtttgggttttttactcctcacaactaaaagcatcccagcccagagtgtcacttatccacgcccttcaccatgtttggcggggagaaaatatccctgccaaagggagataccatataaactcttcttcacctatggcccaaatcaggccctctgcttatttttgtaaatagtgttttattggaacacagccacactcattcacttacatattgcctatggttgcttttgcttgagcagttgcaagagagatagtgcagcctgcaaataggaaaatattcattatctggccctttacagaaaatgtttgccaatccc

SEQ ID NO: 262926 - DNA, 355 bp, Homo sapiens
cattgtattgatttgtatgccattaaatgtttcctgtggaggctattaccttgatgaaacctttacgctttaaaagttttctgctttaaagttaacatcttggccaattggaaagttatcatgaattaaaaaaaaaaaattatttgccattcctttaaattttttgaaagttgttttagctttttctaagttatatttgcatacatacgaaatgtatcctgtgtgcatctttgacatgagggcgcattaaaactttattaaattgatgactaaattgatggtatccaaagtgcagaaccttaggttggagtagctttggttatttaaatgaagacattgaccaacctccagacag

SEQ ID NO: 262927 - DNA, 357 bp, Homo sapiens
gaaaatgggagtgtaacattccacctcctaggactgctggaagcatgatatgagctgattctataaagctcttggagcggtgcctggcacgtggcaggtccagcctaagcgttgaccatcattgtcatcagtccatgaggaggagcagatagccactgaggttcccgtttataaggggaaaccctgaggcttggagaaagagcttgacctggtctaattcccaggatttcggccctgccttcctgcctctaacctcctgctggttcccttagagccacagttctagaagaatggctgggcaagttgataaaatgcagattgaaccagcctagactgggacctgggatttcaattttt

SEQ ID NO: 262928 - DNA, 179 bp, Homo sapiens
gccagggagacaaaagttgttcactttggtgcacatgtggaaccaacatgggacaaacaggcattttgtgctcgtccagggaacatgacttcttcggctcccacacaatttgtagctgcaggagtggcagagcaccagagtggatgcaggcccagatgttctctgggttaggtgttaag

SEQ ID NO: 262929 - DNA, 311 bp, Homo sapiens
agaagccttgggatgtgggggaaggctgttcttatctggggtttactcccaggccaggggggctgccatcttcttcacacacattcctcaaagaggaagcccctttggggcagggaggtaaggacttcatctcaacatagattggtggtcggcacgagcagagggggatacttttggctttttttttttttttttttttttttgacacggagtcttgttctgtcacccaggctaaagtgcaatggtttgatcttggctcactgcaacctccgcctcctgggttcaagccattcttctgtcttagcctccct

SEQ ID NO: 262930 - DNA, 613 bp, Homo sapiens
ccacaatttaatgcttccagaagcaagaggcaacatgatataatgaataaaacacaagaatggaggaagaagactccagtctgagtgctagtaccatcactgtcatcttcaagtaattagtcacttccatattgtttcctcctctgtaaaatggaaacaatagtcactaccttttgtgcagaagtactgaggggatgtgagagaaagcagtttgaaaactgtaaactaagataatattgtatattaccaacatggaggtatacttctgtttattcctcctgtaggcttcactgtgggagttaagaggtgccccaaaaattaaaaacaaccggctgggcgcagtggctcacgcctgtaatcccagcattttgggaggccgaggcgggtggatcacgaggtcaggagatcgagaccatcctggctaacacggtgaaaccccatctctactaaaaatacaaaaaattatccgggcgtggtggcgggcgcctgtagtcccagctactcaggaggctgaggcaggagaatggcatgaaccggggaggcagagcttgcagtgagccgagatcgcgccactgtactccggcgtgggggacacagcgagactccgtctcaa

SEQ ID NO: 262931 - DNA, 365 bp, Homo sapiens
caaagtgctggaattacaggcgtgaaccaccatgccctgccacaactttggcttctatttatttatttttgagacagagtcttgctctctcatccaggctggagtgcagtggtgtgatcttggctcactgcaatctctgcctcctgggttcaagcaagtctcctacctcagcctcccgagtagttgggacaacaggcacacaccaacacacccaggtaatttttttgtatttttagtagagatggggtttcaccatattggccgggctgttcttgaactcctggcctcaagtgatccacctgcctcggcctcccaaagtgaggaagctgtgagccaccacacccggccaactttcgcttgttaga

SEQ ID NO: 262932 - DNA, 1799 bp, Homo sapiens
cgctcatggagccctggcattgagtgtgagcacttcacactctacctctctcagttggccctccgaaatgcctcaatttaggagtggtgccccactgtggagggtattttcaggaccatcttacaaattattgtgaagtgttggaaacaaagagcttcctgcttcttttcaacctggttctaccatgttccaagctgtagccaaaaggaaaataaatcagagcttgaaactagcctttctgatgggaatatctatctgggacacccctccctttttgtctcttgcccccatacgtctcctccttacagcacaggctgtttgggaaggaggacaggatatgtcatctaacttttttccatccctagctgagtcactgattaaaaacaaatgaacaaacaaaaacctaaaaaaccttccagaaatacaaaggaaaagggtttgtttgttttttattttaatttttatttctgtaggtttttggggaacagatggtatttagttacatgagaaagttatttagtggtgatttgtgagattctggtgcacccatcacccgagcagccttcactgtacccaatatgtagtcttttatccctcacttacctcccaccctttcccctgagtccccaaagtccattgtgttattcttatgcctttgcatcctcatagcttagctcccacttgtgagtgagaacatatgatgtttggttttccattcctgagttacttcacttagaataatagtctccatccaggttgctgcaaatgccattaatttgttcttttttatggctgagtagtattccatggtgtatatataccacaatttctttatccactcattgattgatgggcatttgggctggttccatatctttgcagctgtgaattgtgctgctataaacatgcgtgtgcaagtatctttttcgtataatgacttattttcctctgggtagatacccagtagtgggattactggatcaaatggtagttctttctacttttagttctttaaagaatctccacattgttttccatagtggttgtactagtttacattcccaccagctgtgtaaacgtgttcctttttcaccgcatccacgccaacatctgttattttttgatttttggattaaggccattcttgcggagtaacgtggtattgcattgtagttttgatttgcatttcccagatcattagtgatgttgagcattttttcctatatttgttggccatttgtatatcttcttctgagaattgtctactcatgtcctcagcccagtttttgatgggattgtttgttattttttcttgctaatttgtttgagttccttgtagattatagatattagtcctttgtcagatgtatagattgtgaagattttctcccactctgtgggttgtctgtttactctgctgactgttccttttgctgtgcagaagtttttatgaagcaagtctttggggaggatattttgtctcataaaagttattacaaacatcaagaaagtggattccagccgggcgcagtggctcacgcctgtaatcccagcactttgggaggccaagacgggtggatcacgaggtcaggagatccagaccatcctgggtaacacggggaaacctgtctctactaaaaatacaaaaaattagctgggcatggtggcgggcgcctgtagtcccagctacttgggaggctgaggcaggagaatagcgtgaacctgggaggtggagcttgcagtgagccgagattgtgccactgcactccagcctgggggacagagcgagactctgtctc

SEQ ID NO: 262933 - DNA, 621 bp, Homo sapiens
cgatgctgtagtcatccccttcgtgcggggagctgtgtctttcctggtgtgattcgtcctgcgcgggtggtctctggagaagcggctttatctcggcggcttttccctaacttaattaggtgcggcaccaatagaagattcgatggacatggacatgagccccctgagggcccagaactatcttttcggttgtgaactaaaggctgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatga

SEQ ID NO: 262934 - DNA, 253 bp, Homo sapiens
agtgcatattagtggacagcacttagtagctgtggaggaagatgcagagtcagaagatgaagaggatcgttcagaagaccacctcagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatga

SEQ ID NO: 262935 - DNA, 278 bp, Homo sapiens
gtccccatccactgtggcctttcttccctttgctctttcaattcccagtttatttcctgtagagcagtttcaccctcttcaccaatcttgtttatttccttgtttattgtgcctcctttaccagaacgttcaccctctgagggcctgggccaggtctgtctgttcacagctctagtgctcagagaagtcactgcataaataaacaaatactttgctcagaaaattgtggatatgtaaatgaaataggtctgaataaatgaattaaatacaaagcatat

SEQ ID NO: 262936 - DNA, 1513 bp, Homo sapiens
tgaggctgcatggttctgcaggaatccccaccttggagagagcaacccaaaaacaatcgggatatacttagaaatcactgtggggcaagtttcaagaagacttacccctacaatgtctaggcagtcctgaggaatcctgcagatcttttgcatccttggggattttgtggtttattcctgcggctctgcttgacgttacttcaggctggctcacatctgtaccctcctgggaacatgggattatctcatggatcccacagagaagacaggcaacagtccaaagccaacacacttccatggaaatcttcttctccaacaagacacagggacttgttgctaggcaatggtgacatgtattgtgatgctagccagagctcagaatcaggccttgtgccctgagactagcacatgcacatttgtgagggaggcttaggtactgtgctgtcagagctgtcaccctatctaagcacagaaaaatggtacaggcagagcaagcctggtatcaaaaaaaaaggctgcctgcaaacctccacttcaggaccctaaaactgtcaaactgatggactctccagtccatcttggtgatcgggtcatgccagaggcagaagctttatgttactgtgaggtggtcacaggaaactgctcttgtgactccattcaggaaagacctatgtgcaagaatcgggtccagcggggattggcatataatctggtgtgttgttgagggttcttttggtgataaaataatacctcagatcccagagttgggtgttagtgaaagatgtccaggttcttgacctcacttcctccctttattctgagcctcacagggctctctgggaaaagcaggaaccaagacaaaggcaattccaagttggagtggtgttcttgtacctcggattggcctctcactagtgcatatgagtatagacagtgtctcagaggctgtctgtggtgatgacaagcctttaaatggtgtccagtagtgctgttgatgggcactgtggattccctgtgaaagcaacagaaaatcaaggctcaccagagatcaagcggtcttgtgctggagcccaagtaatgttcaatgattcctgtcagaggacccaaaaccatcctccaaagtgcaaacatcctcaacccccaaaaagagacaacaacccaaaacctggagtgcagccagaatagccaatcttttttatggtctctcaaatccctggccacttaataatctatggtgaaaagcagtccaatctggcaacatcccagtgaaagagcccctccacaataagaaggccatgcagatgacatgaaacagaggctagattaccaggaaaatgaagacactgctgcctgtttctcatcctgcaggaatcacgcaggcctctgatagaagtggaagaataagagttttcttctggatggctttaatgggaatttatggttttaaaactatcaaagcgtcccactcattaaaacatgacaatgtttagaataaaacactcacaaatggatt

SEQ ID NO: 262937 - DNA, 417 bp, Homo sapiens
tttccaccttagcttcccaaagtgctaggattataagcatgagccactgtgcctggctcaacctgtcttttgattcattcatctttcactgagtatttactaaatagcagctatatgccagacactatactaaatgtaaggaatccaaaggttagacacttacattacttctcttcaagaagcaggagagtgagcacttacaatagtgtaataattaccatactagagatacaccgtgaactacaaagaggatagctatccctgaggtgcacctgcaaaaatatcacagagtaggcttgcttgagctgagaaggtcaggtgggagctgaaagggggtgacattttaggcaaagaaacggtgaaaaaaaatagcatcagagaataacattctaagaatagcaactgctctgagtttga

SEQ ID NO: 262938 - DNA, 382 bp, Homo sapiens
tctgtgcattgctctctccgatgaggaaaacgtggagttctagacccccagagcaaactcactccacttgcgcttctctcctaagtcccgaaggcctaccagattctgtcccctggggacagtcccaactcactgcaacctaaaaatggtttccacatgtttataaccatgggataaggaaggccttcttaagaaaggcacaaaaacaagccaggaagataaaaggattaaaaacccaggcaacatagcaactcacaattcagaacaatgaaagatataggcaaagttaaaaagacaagtgacatattaaaatatctgaagcaggtattacaagcaaagaactaatattcagtataccagcaatccctacaattcaataaga

SEQ ID NO: 262939 - DNA, 414 bp, Homo sapiens
ctttgaataccacataaatatatgttaacccttgaatgtgacagaagccagtccccatctgtgatatttcaaatgacagactagaatcacttttcatccccactgcagaagatagctatcatatttatttcaacaatgggaacttgttttcttattttgagggccagccacattcaattatagatctttcatcagtagccatacctttactacaaccttggtttttcttatcacaaattattgaataatacctgtaatagtttaggcaaacgacaactgtaataataaataaaatttacagaattgattcttcatactgcatggttcttagattagaccagaagtcaaggtgaacaaagagtgcatataatctaataaattattgatttatttcttgttaaaattttagataag

SEQ ID NO: 262940 - DNA, 564 bp, Homo sapiens
ctgagtgacctcaggcaagtcacttatctctctctgcctcagttgccccctccataaaatgggcacaacaatactcacctcataaattgttctggggtgcatatggtattatacacataaagagcttagtagtagtgcccacagtaatctcccaataaatgttatgtattatttcattatcacaattagcattctgttagaacacattccaaaggattatccacattaagcattgttctagagctttgttttattggaaactgcaatgaaaaggccaccagctggagtcttagagaccttttgtttatccaaagagcctttataattaatctttatagtgagattgttatataaaagtgccaggtactagctcctagtaacacaagggctgaaatggatttcaaataaggcagtgacttgtccaaggcccatggcttgttggtctcagagctttcagaaccttaccttctatcagaagacacagtactgggtacagcacagccacctttagagcactctgccttggtccaaagcaaccacagacagacttctgttagaacactg

SEQ ID NO: 262941 - DNA, 349 bp, Homo sapiens
tcagtgatgctttgaaaatgcatacttggtattactgttttaccaaatgcagcttagaaaaatgcccaaagcagaaaaaggcttcttttccctttaataacatcatcttctatatattttaaacaggatttttaactgacaaaatggtccttttttaagtccaagcaattaatcagaatcaacagttttctaatttagtgtcatcagaatttgttagattaaattgcagaatttcatctcaccatttctgtacttgaagacatttaggatgaaattattaggaacattttaatgactcataagaggtccttaagaaactgattaaatcatgccaactctgagctaaaaa

SEQ ID NO: 262942 - DNA, 436 bp, Homo sapiens
gtcacatgcccagagccacggcactctcctcaccaccgtatcctgtagccagagtaaaagtgacaagcctaaagccaagttgctgctcttcaggtttctcccctgcagatagcagaaggctcgtgtccagccgtccggttagccatgtcccacaggtctgccagggcagacgtcaacagagccctgtccacttaacaacctcagctgtgggtttttgaagcttgttctgtgctgttatccatcacggcctttctgtggctccgcacatactccctgattctatctgactcacatagttccagatagtatcttcagttcttgttgtagatgatgtgtcatagaacgtcatcagccatcggtctggcctagccccaatctgttaaaacacacggtaggagagactttggtgaggtgacccagctgcagaagttaacta

SEQ ID NO: 262943 - DNA, 448 bp, Homo sapiens
ccaggcaggaaactgaaacccccagttaaagctgggaccctgaaagagcaacagccttagtgaaagaggggaaaccataaaaaaaccccacccaggtggtgaaaggaagaagcaaggaagtctgaatgcctaggcttgtgagatcaggagattgttgaaaattctgaatcctgggcctgccccttatgtcaattttagaacatttctcatgtgaataatgagtgctcttcctgtatggtctggaaaaccaccactcccaccaaatccccagccaagaaggttctaaaaagtggtctcagatccactgtccacaggtttgctctggagagacatatgatgcaggcaacatggaactctacagccaccctcaccctataaaaactccaaaagatgatttcagtcaaacctgcaacccatgtaactaataaaatactattatccagaatat

SEQ ID NO: 262944 - DNA, 242 bp, Homo sapiens
gcttccttggtatgtgggggaaaactgaaatgtgacacatttgctcacaaaagcattctatgttgtcagattatagtaagagaaactgggtttgttttttcctatatccttatcacaaataaatacttctccaaaatagacacacaaatggccaatatgcacatgaaaagatgctcaacatcattaggcatcaaaactgcagtaagatactacttcatgactgggtgcagtggctcacacct

SEQ ID NO: 262945 - DNA, 1211 bp, Homo sapiens
ctttgagagcaggagcaatatcttcaatgtcttcttgaatctgggcaggctcagtcactgccttgaccaagagaatgatgataatttgagaaaaaatttccaaaaggactgcatataaacattaaacttcagggtcctgaaagtccaggagatggagaggctgttctagactgaaggagacaagaaacaggacaagtgggtgcaacttgtgaccctcggccgattcctgatgctctgagggattgctccgcagtaagcaggtcacacaaacctacccccaaaggccaagggagctgagaggctgaaaaaagaggctgacaaatggagtttctccaaaagaaacatttactagaaacttatgaacaaagtagtatctcgggcagccacaagacagtggatccctgcacctgccccccagaaagcatcctttatatagcaagctttttggtaaaaacatgtgcagctggtgatgtcttagactttcttgcaaaattcatgactgctggggaagttaggtagcatctttctgaggggttatcaatgctacaggccttgtgtgaagaccttggtatgcaggagtctaacatcggccaccacagtgattttgcttcgagatgacaccactcttgccaggcaacaggctcctttccttcagagacattgcagggacacctggtgacccttgaatgggggtctctgggaaggtgcactattcatgcaaccttttatctaagcttgaaattgtttcaagctaaattaacttacaaatgttgatcatagtaaggaaggagaccaccacttctcctactgccctcctctccccctgtcttgcctagtttataagacaggagaaatgggagaaaacaaaaagtgagaaagaaacagaagataaatagccagatgaccttggtgccatcacctggccctggtgttaataatatcaacccctaacctaaactacttgtgttatctgtaaattccagacattgtataagaaagcattgtaaaactttctgttctgttagctgatgcttgtagcctccagtcatgttctccatgctttcccagtctatcataataaccctttcacgtggaccctttagggttgtaagcccttaaaagggccagtaatttctttttcgaggagctcagctcttaagacacaagtctgccaaagctcccagccaaataaaaccccttccttctttaac

SEQ ID NO: 262946 - DNA, 349 bp, Homo sapiens
ctgagttattttccttaagtcttactgtccaggcaaaccaagagtgcacttggggaacttgacttgaaagctcttgcccttaaccttggcactatactgtccccccaagctaatgttccggaaatattagtggagaaatgattaaatcctacagtcccttacagatagcaccacagaacctgtggtgtttacaaatgctttcaagtcatcatttcctttacgatcatcatactcttgattttaaaggacagtctaaaggcactccaggccgagtcccctaaccttacccatctggaaattgaaaacaagcaccatcagtctccaaggagtcctgagctgggggtgcttt

SEQ ID NO: 262947 - DNA, 770 bp, Homo sapiens
aacaggggctgcgtgtggaggggtggacgatgttatttgaaaagttacaggacagattttctgtgttaatggacatgagccatacattgagagggctgctggctactgaaagaaatataaaattttaaaatttctgaaatcatgcagttaacatctgcacacttcactatattttaagtttttgttaatataaaagaataagaaaacagaaaagtattactgttaaacaataatagagaaatgtatactttatttacaaatttctccctctagctgatcatacagttgaccagttcagggtgcccgctgctggttggatgccaggcggaatgtcagggtgttctctggtgtctgttgtggctgtgggatccacggttactgggcggagccctgtggtggctgtggtgccatggaggggctgcgatcttctgtggagctggaccctgagctgactccagggaagctggatgaggagatggtggggctgccaccccatgacgcgagtcctcaagtcactttccacagcctcgatgggaagacagtggtgtgtccacacttcatgggcttactgctgggtctcttacttttattgactttgtctgttaggaaccaactctgtgtaagaggtgaaaggcagcttgcagaaacactgcattcacaggtgaaggagaaatcccagctcattggcaagaaaacagattgtagagactgaggcatctttaaaagatgtcagggtacagaaaaagtctttcaacacccccggctttgta

SEQ ID NO: 262948 - DNA, 336 bp, Homo sapiens
aagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactt

SEQ ID NO: 262949 - DNA, 579 bp, Homo sapiens
gttgaaatgaggaaaactagacgcctggaagggaaaataccaccctaaatcatatgcttattctaaatggaatattaaattaaattcttcacaatgaaggtattcctgacagagcagctgtcagtcactccctgttcagacaccacattgtgggaacctcgtcactaccacattgcagaaggctggtatccctggtaaagatgatgtatatcatgtaaaccccatcatccagatcaaagtctgcttctttcatggaagccaatacatgtcaaacctcattccaatcaaattgtctggaaatgaattcaagatgaatatgtcacagaataacgtgacagtggaattgcagaaggtcaggggtggttgtttcaatgagagaatcgtcaaatattaattctggaacgtccagatgagtaggcattgagggggattagctggctgctggtgggacgttgtgtcattgatttgtgtgcaaatgtattgaacactaaggagttctaagtttcatttgaactcaagaaactccccccaaactctcaacccaacataaacaaaagacaaaacaaaacttcctactta

SEQ ID NO: 262950 - DNA, 463 bp, Homo sapiens
aacgtgttactctggggatagcctaatcactacgaaattaattttctgagctcctgagaaacttgccttcctaaaaaccaagatggatgcaaatgaacaaggactgagcagcccgaagcgggtccatgggggtggcagcggcacccctaactctggccgggtgaggggccccgtccaggcagcctcagtccaggctctaagcaaacgccgtggcccacaggtgctgcttctgggatggcgtcgggacactcctgcgggggtagcagagagctcggcccaccgactagccgctctgcccgctgacctgagtgcttctccgacctccgcagtggacgttcacctctaaaccttccttcatgtaaatgtttggttcccatagctgaggcaaatgcccttgaaaatgcttccatcaggaaacattcagacacctaaatatatactttgtatcaagtttaatgaacac

SEQ ID NO: 262951 - DNA, 694 bp, Homo sapiens
aaaagatttagtgtttcttttggaatccgaagacttttctggatttgttgctagcacagttgcccaggaagaagtgtgactagccagtgggtgtttgggggtgaaatccagcctgtgccctgctaactactaacactgtacctcagtgtagagctgcagctaatagggaaagcactgtatctgctaaatggagctctgtctcctgagtcattaagccagttagcactgtcctacagaagcttggaagtgccagttagtagacttttccatttagtaaagtgctgaataaataaacttttactacaactggtttctttaaagtgtttgtacttctaatgatattctagaacagttttgaatttttttctctttgtcatcacatagatgcttgtaaaaccagccgaatatcaggaataaactatttataacataggttgacatggtactatttgaaatgttttgtggactgcagatgtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctatta

SEQ ID NO: 262952 - DNA, 179 bp, Homo sapiens
atacctctttctctacattttaccaacaacgtacattagtcaattttttgtctttgatattctgatagaaaataatgtcatgctactgctttaatttgcttttattgttttactccacatgggttgaacaccttttcatatgtttataagaaaatatatatatatattcatgtaacata

SEQ ID NO: 262953 - DNA, 450 bp, Homo sapiens
gctaaacgtaggtaaatgtggtcattccttctaagaatttttatgtctctcacaccaaatccacattcgactgttgttttcattctctgctgtgctatctctatggaaacttttcctattgacattgaatgctagtgtaatcattttgaagacatttaaaacagggattgaaacacctatattatcaacagtgcatataactcaattgtgacaatattgtcagcagctgcaaccaagttcttttgagcacaggcagagacaagcttgtgattactgcctggccaacaatgattacgagatgtatcctgatttggaagatttttaaatttgaaaagagtgtgttttagaatggagttaaatgcactttgtttatttgaggtgaatcaactgaattttgcagatgcaaaaactgagactcagtgtagttaatcattttgtttaaagtcgcag

SEQ ID NO: 262954 - DNA, 545 bp, Homo sapiens
gcgagaatcatgtacattccctgtctgcagatctcattctcctgcctcaacatacagtgatgttaatgtgtacaaatttaactgatttgttccaagtaaggactatattcataagcacagaagtcttgatagttagaggtgataattatttgaaaagacaatcttattcaacatagctttttaacaatttaagattctgtcaatttgttttttctctgaatgttcattcttattttcttaagattgccattttctatttccatagtgatttccgtatcttctagttactttcagccttcattttaatgataataactgccaccatttattgggtagttatgtatttaaggcactgctaaatgctttatgtgcattatctgtgtgagttggtattattatttctgttttttccctaagaaaatttgtgtggatattgcataaattgcactggttttcactactagtaaacaaaagaaccagaattcaatctacaatttatttgattccaaagcccaaattttagtctcagtactactttagtaata

SEQ ID NO: 262955 - DNA, 682 bp, Homo sapiens
gatgaaaaaatattgtgtgattaataattatgctttaattaattttaaaggatataatttcagtacttctaattctcccatcagcagttataacaaaggattagtgaataaataccatagactgttttgcctagaattgaatccaatctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaatagctcatgaacaaaagcatctatgactaactgttgctctgtgtcctcctagcctctgaggagtctctagttcacaaggacagaggagatggagagaggccagtcaacgtgagggt

SEQ ID NO: 262956 - DNA, 1005 bp, Homo sapiens
attacagagatgcagttgtaggggattaatgaacaggctgtttggttaaaataagtagactatagctaattatttgatctatgtaatgttagttggtggttcatgaggaccctggttaaaaagcacgcttcaaactcttcgtattatcctcctggtagtcaaaatagtagtctccctgctgcattgtattctcaaaagttagaaatgttttcatgcaatcacctgtagaatataaaattgtctctcactaactggaatgacagaaactcaaagacatatgtaactatgatgaaaccataacctaggaatgacataagaacaaagaccctaaataatggaaacagtggtactaaggccctgagttttggttacactgtgcactgttgaaaattttttgaacaaaattattagaggccatcattctggactgagcttgtgcactaggtccaaacagacaaaatcaaactgaaaatttaaggaaataggtagattctgtaggttttgtttttcttctgtaaacagcagatcttaacacaaggggtttccctctactcaaacctttaaaaataataataaaataataacctgaatttcttgattccactttacaaaacccatagttctgctatttcacagtggaatctgagactaagtacatttttgatggtgacagtgttatcaatgtctaaagttttggtctatcaaaatttagaagatgaccaaaaaaggagaaattgtttaattataccctaaatctaccccctttcatgtttaagtttggtcaataagtttttttgttgttttgttttgtttacatagtaaactgaaacctaactgaatgtgtaaatagactgtactcatttttgtaccaacaactgtgttttggccaataaaaggatgtcaaatgttcaaaccatgtttaaataaggaaaatcccaagctgtaatcaatctagctgttcctgtatttcacttctattttctgatgtcaccttgcttcttctgt

SEQ ID NO: 262957 - DNA, 988 bp, Homo sapiens
acttgctggaggttcattgtgaaaaagtttgagaatcaaaatgtatgtggtggttgggtggggggatcttaggggccccacacaatttcaaaagttttaccttcaggagtcctactgtgttcctgagtgaagattggagagaaatcttctcttgcttcttgcacagggagggaaaaagtagccattttgaaattctgcttccaaagcatactgttcttctaacaaggaatgtcctcagagaaactattttttcagaacctaacttagtaaggttttacaagaaactaatggacttgacctaggggaaatgaaatatccaactccagtcctctctaggtttcctgtcctactgaaggggtcaaagcagaataaaattgggaagcacatgttagggtcacagagcaggggcacatgctaactaaatgactgagacctaatcatatgactataaaatacttcctctccttgtctccacacaccttatcactacacaaatagggattttctataatgggagttctatataaaccagaagaacagtacatcataggtgttatttaagaagtctctagggaaactcaaagacaacagaggaggtggaaacaatggcactagttgaaaattttacacctgacacctatggctacagcagacagtaaacacagactaacccctagccagggaaacataaaacctcacattaaaggccaaatacccccagttcttttatctcagtacatcatgtttggctttcaacaaaacaattataaggcatactaaaagacaaaatcacagtttgaaaagagaaagcaaccatcaagatttgactccaatatggaagagatattgaaattatcagactgagaattgaaaccatttgtgattaatatagtaagggctataatggaaaaactggtcaacatgcaagtacagatctgtaatgtaagaagacagatgggaacttcaagaatcaaaagcaaatgctaga

SEQ ID NO: 262958 - DNA, 424 bp, Homo sapiens
cgacctcacctgcctcccctagggaaggcgatcctaatatcatttctcttttacataaaggagagtgaggcttagaggcgccagctgaggtgtcagtcacatcctgaaggaagacttctcttatccctgaagggttcacaaagaaggcgaagcaacgaagttacagcagaatttgcaaaaatctatccacgtttctaccccagtccaaagctcgccatcaaaactcatctcaggagagctatgattggtggtgcagggtgaatgtcacatttagatttcagcatttgaggcttccagccgtactggcagaactgagaggccttgctcatgcgacttgaaacttaagcgctgtttccagaccagggtgcttgagtgcactaagaattaaagtctttgatgaattctataattagcttatcaacag

SEQ ID NO: 262959 - DNA, 522 bp, Homo sapiens
gatgaggttaaagctattccagacatcttatttcatgaagaatggtatgacagagaaggccctaaagcctggtgctcagagaaactggtaatggccccaaaggatgactacactgtggccagtgatgcatggcagagatttgactgttggaggccaaaagattgagggtcgtgattaacttagtataccactggaggctatatgagtaaacagcaaactgttctcataaatgcggaatgttggcaaactgacaaactgtgtatgccacccagaaggagtgctgagggcagtcacaccccaagtgcaacgtttcttgtgattaggtacatctgaagcctcttggtaataatatgaacctgtgatcaattaagcagccgaccaattgttactgccgcctccttgctcttgttacccaataaatacaaagggctgtagaagctccgggaggagggggctgcccttgctcactagaagcagggagctctcttcttcttcccctggccctttctttaaaacagattt

SEQ ID NO: 262960 - DNA, 440 bp, Homo sapiens
ggctctctgtttcattcagtccttcataagcatgcagcctgacctggagaaactgacagtgtaaaatgcatggagcagctcctgtccctctctttcctacccttgagcactctctaagcagtagctggccgatacagtcgcccaggaagtctccctgtagctcggccgtcagtcattaccctcactggcagcacgggacagagaacgggatatgttctccccttttattttgtgtggtgagacttggaaaactctgcgcctagaaaaatccatttctgaaggttgctgctattgagtagtgcagtgagactgggtttgaaggtattggactcttacataggctatgtgaacgtgggcaaattgcatcttctctttgagaagtctgagctcaagtcttgctttgagttatttgtgtactaacctttgaccttgctgacaaa

SEQ ID NO: 262961 - DNA, 346 bp, Homo sapiens
aatgggttatggaggcttgatctttctcccactcacatatttggtgaggtcatgtcaaagttagcccagctgtattcgcaaatttcaattcataaatgtctcaatagaggttgattgttttgctttgatattctggggggatttgctatttgctaatgacactcgatgtctaattatctttgtgcgaattaaatttaatattaggaccagttggtgaaatactgttttaagacaagatgagaactttctctccaccccacatatttttctttacaaatgtatcattgtttttgtaccatttctgtgttaaatacaaaagtagtatcagccacataaggaaatttga

SEQ ID NO: 262962 - DNA, 419 bp, Homo sapiens
tttttttcactcacacagggagcaggaagttttgtgcacaaggaatcataaagtctttcaaatgtgttggtaacttgggaaaagatggaaatgtttatttccctggagattatgtccttaaacctggttgcactgtgacttgaaagaggatcctaaaatgtcacaggaacaaaaggttgtgattgtcagagagtagttggaaaggtctggattcggtggcagtgagtacagacagaaggcctggaaagaggtagtatatattgggttcttggtgagattaaggcagggctgacttcggcttcttcaatagtgggatggggaagttggggaactataaaatgcagaactgctggattgttgtttttgagatgatagtgaagagtattaagattgtgttggagctatagtttaaaaaaaaa

SEQ ID NO: 262963 - DNA, 665 bp, Homo sapiens
caagagcactgagaccccagccaacagaactatctaattcagtattattaagatctgaaagatcagtggcaaagcattggctattttctgcaccttgactatgcaaaaattaaaatttggccaggattgttgttcgtagcaggagtcatgaatggttttgtggtgttttatgacatcttaagggccacattgaaccttgttcttatattatgatctgctaagcaattcaccaaccatacttctccacctcagtcctgactttagcctccttaggagaatattggagacatgattggtagtaatggcccatttcttgacatttttgaccagctatagagcccatgccagatacacatatgtatgtgtgtgtgtgtatatgtagtgtgtgtgtgtgtatatgtagtgtgtgtgtgtgtgttgacttgcttaaagatgttacagggaagattatgtttaagaacagttagagggaaatgtctttttgagtttgtttcctaaaccctaagccattcagctgaccttattatgtctctttacctcatagtgtaaaagtcaaaatgtgtgtgtataatgggaaaggagagaggcgggaggagaagatgaagggattaatatccatgagccttttagtaaggacctgccttttactagagactgagcactcc

SEQ ID NO: 262964 - DNA, 747 bp, Homo sapiens
caatggaaatttattgtttcacagttctggaggctaccagcctaagatcaaggagtcacctgggttggttgcctccggaagctctgagggagaatccattccttgcctctctccttgcttttggtggttgctggcaatccttggcttacggatacatcactccaatctctgcctcagagagaatcctgtgattctctctgtgtcctgtgtcgtcatatggccttataaagataaccagtcattggatttaaggcccaccctaatccaatatgacctcatcttaattcgattatatctgcaaagaccctgtttccagataaggtcaaattcacaggtcctgggggttagaatttcaagatacctttttgaggacacaatttaacacacaatggtataattttagaattttgattttgcttgtttcatctttcctaaattagttttttaaaattgtctctcctataactcgtcttaaaaatgtgagaacaagaggtgactataaagcatcattattaaaccttagatatgtgttcaatcaagtattcctattttacttataatcttataaaagagcagtgctccaaatttaccctaatgattcactgatattcaacatgaaaactcactgtagtaatgagttgggtcctcagatcaggaaaatatatatatggtttttaaaatttataattactaaatcaaccaataacatttataattttaaatatattcaataaatatctaatgaat

SEQ ID NO: 262965 - DNA, 432 bp, Homo sapiens
agtgaatgtgacattagtctctgtgatgcccctttctaacagcacttcatagatggtactgattctgttatgtcactaatctcatgtgaccctgtgttcttgtattcttcaatacctcccactagaccgtaaaacttattgaaagcagggattcttgtatgcattttaaaatcttccattgtgcctaggtgctcaataacattggtcgaattactgaattgattatcaagctctgatgtggtatagcctccggttgctgtcccttgcacatgaagataaagttattgactcactgtcagtaagacacatgccttggagctgtgtttttattttcttttaatagtggatttagttttgtgctaatgataatgatgctgttgataataataataataataataataataataataataaattactttcaactgg

SEQ ID NO: 262966 - DNA, 732 bp, Homo sapiens
gaataagctaggtgaactggaaaaactaccccaggcagagaaagaaccatgcagacacagagtgggggagaagtgaggagaataacagacagtgagaggaggaaggagaaggaagaagtagaaggtaaaaggaagaagagaggaagagagagaactcacctggtgctttctagaaagagaaaaaagtttaatgcaaggtaggttagggatcacagacatagatgagactggagaaataaggggagggaatatgggcagatcacacagtgctttcttaaggttaaaaaattcataaaaacaggaaatcccttaaacagttttgagatgggatcagatttgttttatgaagtttaccacagttgtgtttagaaaagattgcagaggggtaagatgggaggtgatattgtttggctctgtgtccccagtcaaatctcatgttgaattgtaatccccagttgggggagggacttggtgggaggtgattggatcataggggcggatttccctcttgctgttctcatgatagtgagttctcatgagatctggtcatttaaaagtgtgtagcgcttcctcatttactatttttctctctcctgctccaccatggtaagccgtgcttgcttcccattcattttctgccttgactgtaagtttcctgaggcctcccatccatgcttctggtacagcctacagaactgtcaattaaacctcttttcttcatgaattacctag

SEQ ID NO: 262967 - DNA, 366 bp, Homo sapiens
agtttcttaaaagtgtacacctgccatatggtctagctattacactcctaggtatttacccaagacaagtgcaaatatatgttcatataaagatttctacacaaatgttcatagcatctaaacaacccaaatgtctatcagtaggtgaatggataaacaatttgtggtatatccatacaatgaaacactacttagcaataaaaaggaataactgattgataaatgtaacaatgtggataaacctcaaattaattatgtggagagaaagcagataataaatagtgacagaaaggagatcagtggttgcttgtgaatagagtggggtagggtaggctgggaggaaaggattacaaagacacatgggaa

SEQ ID NO: 262968 - DNA, 320 bp, Homo sapiens
gtattttttagtccttgtctgattcccttttctacactgtcacactcaattaacatctaatagaagctttttcttgtaggattggagaaattttaagagtataattcaaactgcagggcaattgtagaattgcggagtagaaagacccttgaaagatcatttgtcctgtggttttcaaatgtgtctggtagccaaacgtttttaaacatgaaatgtcatataaaacagatgaaggcaataattttacaatataaatttctcagtttaaaattatttacttacttgcatgttctatttaaataaaggatggtttaattatc

SEQ ID NO: 262969 - DNA, 357 bp, Homo sapiens
aaaacaccttgggctttctatcacaaaaagcccatggtgaaaaagaataaaattaagtctatacaagttcttgacagtaattgagttgcctactaaaacgagaactaccgtcatcagaagaatattctagaatccagaatatacaacacattatctataatgtccagtgttcaattaaaaaaagaagacatacaaagatacaggaaactgtaatcttaatgaagaaaaagaaactatagacggaacctgagatgttggatgttgttgatcttagcaaacagactttaaagcaccttaaacactgaattagtgaaaaatgtggtttaaaggagagaataaatagggaatctcagcaga

SEQ ID NO: 262970 - DNA, 414 bp, Homo sapiens
caaatgatatcaaatatatcatttgattacattacattacattaagatagagtaatcttaatgtaatcttaattacatgaagatagagtctatctaagtgttttaactgtaatgccctagtaagtaaagttttcttatggtttaatttggttatttctgttttgatagtcctttttctggcaccctaaggatgtgccaggaagagtctctaagagaataagtaacttacccaaggtcaaacacactgttataaaggaagccaggattcaaacctaatcctgatccaaagcttatgttcttccctaaacactatacttttcaaggtcacatgacaatctgattttcaaagtcatgatcagtcactttatccatagtcagtggaatcttaattcgtaggtctctgcaaagtaggca

SEQ ID NO: 262971 - DNA, 824 bp, Homo sapiens
gcctttaggttcccattcattagttaactctggctatacctgagaagacagagtaaccagcctggtggttgagtgtacactgtagagaaatacagagccagccttagtcccagctccaccacttgctagctgtggggctctgagctagttaattcaatttgtccagtcctcagattttccactagtaatttgggattaaataacccgataagaaaatgaaccaaggacacagagaggcaattcatagaataaaaaatacaagtggacaataaatatatgaaaatgtgttcaagctctctagctgttagagaactgcaaattaaaataaggcctcattcctggcaaatgttacaagattgataatgcccagcactggcacggaggcgttggcacacactattggtgggaacgtaaattggctcggtcacattaaaagatcatttctcagtctctataaagattttatgtgcaaaccctttgacttcacaatcccacttctcaaaatctatcctggagaaataattgcatgttatggatatagtggtcagtgtaaaattgctggtaatcttaaataaaaggacagaaaaagaaaaaggaaagaatagcagaaagcccaagtcatgagcatgtaattgcaggtagagctacaggttaaaataataaatacctgaattcaggtcaggagcagtaaagagttgatggcttgtgagagatattgacaagaatcatcaggattgggtgctagagcacataatattatctgtctattattaatatactagtatcatttcaatcagcttcatttcccttgaggctaggttcta

SEQ ID NO: 262972 - DNA, 575 bp, Homo sapiens
gagaggctgttctttacaaatttctgaatttcctcagatgagaaattcccgtttccaaacttcctcagaagtgtcctaaccatactaaaggcaaattccacagagggtgtgagtgtcctgggaagggccaggagtaatgacagtgacagtggccatttcaggtcagaatcccaggaaaatacatggagctggggcaaatagaagagcagtcagtaaggaaaagatctgggaataatgatgccagggaaactgtgctttcctaccacccatattttcttgaaatcataaattgttaaaccaagataaaactgtagtgatccccatgctcatctctttcacttagcaaatatagaatcaagctcagtggggtaaagtaatcttctgaatatcacacagctagtaagtggtggagtgcagactagaaactacttcctgggaatcctgagttaccacagttacgacaacagtttgcagcctggctacattatactggcctagaccacgggttggtatccccttggaccaaatcctgccacctgcattcttttgtaaataaagttttactggaacacaaa

SEQ ID NO: 262973 - DNA, 455 bp, Homo sapiens
agctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaa

SEQ ID NO: 262974 - DNA, 836 bp, Homo sapiens
ggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagttaaaaatgctgaaaaagcccagtttgaattgggaaggctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtg

SEQ ID NO: 262975 - DNA, 793 bp, Homo sapiens
  misc_feature (583)..(583): n is a, c, g, or t
ccggaccctgcagccgcagagatgttgatgcctaagaagaaccggattgccatttatgaactcctttttaaggagggagtcatggtggccaagaaggatgtccacatgcctaagcacccggagctggcagacaagaatgcgcccaaccttcgtgtcatgaaggccatgcagtctctcaagtcccgaggctacgtgaaggaacagtttgcctggagacatttctactggtaccttaccaatgagggtatccagtatctctgtgattaccttcatctgccctcggagattgtgcctgccaccttacaccgcagctgtccagagactggcaggccttggcctaaaggtctggagggtgagcgacctgcaagactcacaagaggggaagccaacagagatacctacaaacggagtgctgtgccccctggtgccaacaagaaagccgaggctggggccgggtcagcaaccaaattccagttcagagatggatttggttgtggacgtggtcagccacctcagtaaaattggagaggattattatgcaatgaataaacttacagtcaaaaaaaaaaaagaaagaaaaaanaaaacaacaggctagcagacaaacaataacgacgcgacgcaaaagtaagaggggagggagcacaaagggcgtgataaagagagcacaggagcaaaaaagagacccacacaaagagaatagggaccaaagggagaaaaaacggggaacaccaacagaggaaggagaaaagaagaaaaaagaacgagaaacacggagataagcaccaggaca

SEQ ID NO: 262976 - DNA, 376 bp, Homo sapiens
ccaattgacaaatatattggcaattcaataggggaaagaaaatcttttcagtaaatgatgctggaacaactgcatatctgtatattctgacctgtatatcacaatgtattaaaattttaccagagccaggctcagtggctcatgcttgtaatctcagagctttagggggtccagttggcaggattgcttgaatccaggaatgcaagactagttgggcaatgtagtgagaccctatctttaaaaaaattagccttaagtggactgttaatctaaaaataaaagagaaaattgtaaagttcctagaaggaagcataaagaatatctttgcagtcatggaataggcaatgatctttgatatataaaaagcaccaactat

SEQ ID NO: 262977 - DNA, 428 bp, Homo sapiens
acccatgtccaaattacatataatggatatgactagaagtttgttaggtgtactagacacgaaggtggatatatggagagagaactttgtaaaggcttcctgaagcccaatatgaacatctcatttcccttgatctatcttatcatccctcaacttatcttctcaaaaaacacatgacagtctggcatggcatataatacatttttgcatcgaacgggttgtaatgttgtgttatttgttgtctccaactttgaccgttaaaattagtttatgtcagaaatacacttcaaaacttttgaggattattttctttcatattataattgtttttaataagatgaaggttgtcctttgtgaaattttggaactgaaactgatcacaacttaaaacttgaaatcccaaattaaagtttatttccaggtttaaa

SEQ ID NO: 262978 - DNA, 403 bp, Homo sapiens
ctgtaccccctgaagagtctgatttagtaagtgagagcgagggccatggatttctgtatttggcacatgtcttgagcagttcccatgtaccaatccttgagaacctctaggctagctgaatttaagtataaattgccagtaattggaaagcatattcatatcttctgaaactataaggatactctcattttacttggttaaaaaacaagtgtttcctactgtcctctttacccaggttttaatgtttagtggtgaacagtagttttccctctacatttttttctgaactgataataaatgtatttggctgggagggtgacattgattaaaaaatgtatctcttgaatgtaaatatcagtattacagatgataaaataaattcctccaagaaataattttaaat

SEQ ID NO: 262979 - DNA, 627 bp, Homo sapiens
tatacaccggcactaaaataaacctaatgagcatttctgatacgtaacacctgatgggaagtgaatgaatcagctttgaccactggtgcttggaagaatgacctaacagtgtacataatcaaaatgacatttaaatatatgaaatgatagaaaattaaactgttcataatgagctctccagtgtgcttttctctgacaacttatttctagtactcagtcatggaatggattatctttctacaaacttgggtggggcgggggtggggtgggggagacacaaccacgttcctccttttatttaaacttatctacctttatagaatcaaagcaaacacaaaatctatttgtgatttctattacaggaattttcttcacaaaatgaaagcaccatcaagataaacggagaaatgacatgaaagtaaacaaacgccacatacatttggtaactatccatattttatctttaatatttggcaattactttaataaaaatcatttagtttaccactttctcgggtcttcttgtatcatttggagacataaaggagctgcaattgcaaagcatttaaaagtatatcaattcctaggaaatcctttcatataggaaaaatatgatggtggtaagaa

SEQ ID NO: 262980 - DNA, 506 bp, Homo sapiens
agtccacacgctgtgtgattccattcataccaacgtccagactaggccagtccgtacagacaggatgaattactggttgccggagggtggggaggttgggggagatggggaggaagtgctgatgggtacagggtttctttttgggatgatgaaagtattctaacatggattgtggtaatagttgtgtaattttgtgaatatgctggaaaccattgaattgtatactttaaatgggtaagttgtatggtaagtgaattatatatcatagctgttaaaaatatatacgatattttaattagacatagaagaacatgaatagagactagaaatatatatatgtatatataacaaggtgttaatgattttctactagtagactggtagatttgtactaagttttttctactatatatacttttctgtaatttaggaaaacctccctttcaattttaataacgagggaaaatttatatttaaaatatcaaagaaataaaattagttgcaac

SEQ ID NO: 262981 - DNA, 229 bp, Homo sapiens
gtgtcttcctacaccgtggtattccccacaacacttaccacagggttaggtgcttaagagctggtgaagtcatcaggcaaggtggaagacagacgatgtgcaagaagtgtgtcacagccactcagctggccacacccctgcccatctggtcacgcagcttccttaaatagctgcttctcaggcaggccttgctcaaggccagagtcaagggagcctcagagacaagagt

SEQ ID NO: 262982 - DNA, 355 bp, Homo sapiens
cgagcaccggcggctggcgggagccgtggcaagaatgcggcccgaggtggcgagcagccactgcgccagtgcagctcgggctcagcggggcccgggccgcgggttcgcagcccgcccagtggtgcctgccgggttggccgtgccggccgtgccaggtgcgcggggcccaggccgcccgggcgccctctccccgcacccctcacctttggccgcgctctcgggcttggggagttgccatatcgaagacaccctcagaccccagctctatctgccgccttctgcaagttcgctgcaaagtcccccatagcaggactaggaaggaaccttttacaaaattaaatactcgagtgtcgtt

SEQ ID NO: 262983 - DNA, 124 bp, Homo sapiens
atttgcgtctcaggtctgctacttgctaagcgttccgtctgcgggcatttgcggaaccctcacagcacacctggtgccgtgctgcattccatcctgataagcaggaatgagaccacattcctcc

SEQ ID NO: 262984 - DNA, 363 bp, Homo sapiens
gagtgggtatgtggagtgacctggaaagggagaagcgatatgaatgttgcactactcagcctgcatgatggggtcaagacactttctgctggaggttgacatttgttttagtagtttatgttgatgcaaagatcctgggaaacatgcatgattttgagccttttcacaaggaagggtgatgttaaaagtgagctaacttgagaaactggcttcaaaatctgggccaatttgagcaacaaaataaataatggtagaagggtattgtaacccagagaataaaataaatatccacaagtccttaatgatgatataaatacataagtggggagaagggaaaacttttgtacagaggattccattagt

SEQ ID NO: 262985 - DNA, 433 bp, Homo sapiens
tgctcttgaggttctgcagaggcctaggccgttgctgttgcacctgtggatgctcgcacacctcacaggtcgcaggaactgctgcagatgggcaagcagaaggccagatgagcacgtgctgttggcactgaatagcagagtttccaaagatctttgaacaaagtctagcaaatgagaatgtcatttgcacagaccccacttgcaaggacccctggcagccttgcccaagagcctctgccttttgtcacagggtcccaggagggatggttcaccccatcttcctggagccagtcaccgtgcagctgggtcaggtcaagtttagttgtgaaaatgcttctccggataccagatgtgttgggcagctttccattccctctaacagaatgccttggggccgtcttcaggccaggtatgtttaatagctgttttcatt

SEQ ID NO: 262986 - DNA, 506 bp, Homo sapiens
tctcaaattggatttcattttcatattttaattaagggttgagtggtatatttagttgtccagttttttcattttaagattgttaatgaagctcatctttttgcaagtgttgctttttttcttgtctttgaccattcagtagagattgagtgttgacttgatagatttgtgtaatttttgtaaattttactggttatgcttttacagttgtcaccagtaaatataggcaactctccagcacagtctccatccactttctccaagacatcttataccctgaggagtactgaataacttgcagccttctgtctttttacccttctatgtataccacatgctgctgcttctgcctgttctgttctcccttcttatatacgtctggacaatatatttttatcttttgaaatgcagttcttgagtcatctttttccagatacctttctcacctctcccaatctcaaatatgtgttgatgctcgtgttctcacatagcgatttctgttgtac

SEQ ID NO: 262987 - DNA, 719 bp, Homo sapiens
gtactaattttaaaattagccaggcatggtatcacacacctgtagtccaagctcctcgggaggctgaagcaggaggatcgctggagcccagtagttctaggctggagtatgctgttctgatgcggtgtcttcactaaactcaacatcaatatggtgacctccagggagccagggaccaccaggtttcctaaggacaggtgtactggcccaggtcagaaatggagcaggtcagaactcccatgctgatcagtaatggactcgggtttgtgaatagccactgcactccagcgtgggcaacacagcaagaccctgtctcttaaaaaacagatgtcattatacattaaattcaagatagaaaaaaatagctataaagggtattattcagagaatcggagaacatttgcagatgactgtatattagataatatcatggccaggtgtggtggtgcatgcctataatccagcactttgggaggctgaggcaggcagatcacctgaggtcgggagttcgagaccagcctgaccaacatggaaaaatcccgtctctactaaaaatacaaaattagctgggcatggtggtgcatgcctataatcccagctacttgggaggctgaggcaggagaatcacttgaacccgggaggcggaagttgcagtgagccgagatggcgccatcgcactccagcctgggcaacaagagcgaaactccatttcaaaaaaa

SEQ ID NO: 262988 - DNA, 432 bp, Homo sapiens
catagtaattttcttaaatatatatatatatattttatccactagagctacttagtgaagtttctacagatgaaatacaaagacatctagaatttgatttaaaatattccaggttgggtgcagtggttcgcacctgtaaccccaacactttgggaggtcaaggtaggaggatggcttgaggccaagaattcgagaccagcctgggcatcgtagcgacaccctgtcactacaaaaaaatttattttacttatttattttttagagtctcactctttcacccaggctggagttcagtggcgtgatcttggctcactgcagcctccacctctcaggagaatcacttgaacccgggaggcggaagttgcagtgagccgagatggcgccatcgcactccagcctgggcaacaagagcgaaactccatttcaaaaaaa

SEQ ID NO: 262989 - DNA, 695 bp, Homo sapiens
cagcagtgaaatattaataatgcaagtatcaatgcaccagcacttttccggcctctgttttcatcacattttctattgtctcattgtccaaagacagtcacatagcaaagaccagattcagtaggcgaagggacttcccaagggtaggcacactgggtggtaggaattactgcacccatttttgcaaacagtctatcaaaggaaggaattagttaaatatttaaaccaagatctaatttcagataaccagtgtgagttaggagaaacatttggcgcaaaactgaaaccaattcatttgacttggtatcaccaaatacacatacagtggctggtatacaggaatggtcagaagatatttaagggactccatctctgtgcaaccctagagcagtttcaattgcatggcatagcgcagactttagctacaggcctctttaaggagacattgtttggattggttttgtttctctaaaaaggacctgggcccagtcttacacaagaaacaagaagatgagttggcaggctctgttattccccttatcacttaagaagaaagtttttctcgtgtaataggccatttaagatcatgcacaaggattcccaggcaagatgcctgaataggaacagctctggtctgcagctcccagtgagaccaacccagaaggcaggtgatttctgcatttccaactgaggta

SEQ ID NO: 262990 - DNA, 382 bp, Homo sapiens
tcatgcatctggagagaggctggggaggaggaggcttgggtttggcttatctaggtggggcttgctaggcttggctctgagctgtggattaaacacaggtcttctccatttgtctttcatcttctttgggccaccggctacataaggcatgttctgatggcaaagaggagaattaaaggggaagtcctattggccaaagctggtcaatgggagagagaagcgtacgcccctagggagagacagaggggagtgaatttttgttgaacaattatcctaactatcacactgttgtgatagttaaatgatttaataactttaacaggctaataacagtacctggcatggagtaagtattcaataaataacaaacattggtagtgat

SEQ ID NO: 262991 - DNA, 412 bp, Homo sapiens
gtggtttgtgtctgtgcacaacacactgtggcatgttggacaggccaccattctatgtcgtccaagataaccagggagaactttgtaagcctctgatcacctgggtttatagttacacaggagtcagtcaaccagcaatcatacactacacagtctgatgccccaatagggagtagttcccaaaaaacccttcccaaaagataccctttgttgtagatgtaccctgaaaagtcagagttgaaagatgctagagttccacttggtcatcgtcgtgtgaccacagtgtctctgacagtgatgtcactaggtttgcaggttgctattcgaccttgtcagattcctaaaacagggatggtttgacaaacacacaagtttaccctttcaggcatctggtataactgtgctaagagac

SEQ ID NO: 262992 - DNA, 528 bp, Homo sapiens
tgttttccatttgggttttggaaagtaaattttattcacctcactaccttaaatgctaattgtatgtttaatttctgagatctagaaaggtttctttacctatgagctcataagataagtaaattaggtctctcttttcctctttggtcactcttgagggcagtgggcttgtgttaatatatttattttgtctctgtacttaggtattttatggtttaagtttgaagcttctgtgccattttgttcctcttttctcaaaatctgccaattattggtaacacgtttatcttttaatgtgagcatccctgtctgcctaggtgaatgtgggtcaccatatggcattgcacctcaagtgactgtggaggtggagtggggtgtgtggctgctcaaggtgcatggaaagcttattttctatgtgcatgttcctgtatcacttggttgggggatcctaattcatctaaggtttggccttatttttccaatcccagagcccactataaactcccatttcaaaggcaaaaaaaaaaa

SEQ ID NO: 262993 - DNA, 467 bp, Homo sapiens
cagcaaacagattttactttcgactttgcagatgataggatttctattgcaactacttagttctgatgttgtagcatgaaagcaaccatagaaaaatgaataaacaaaatgagcctgataaactgtatttacaaaaataggagtagggcatactttggtgattcctggtgtagtgtttcaggttaacatcgcgtgtaaatagcacaattgtatgcataataaaggaatctttcctggtgaccccaaatcttgccctcacagtttttctcctttgtttagctccacttagacctacacctaaaccctaaaagtagcttctttgctcagcatgtgtctcactactaactttatcactttctgaagcagtatgttccctgtatgttttaatattagcttcttctgaattcttctctacgtggtttttatacttctgtccaaacaacttttttctgagttttggtgccctt

SEQ ID NO: 262994 - DNA, 526 bp, Homo sapiens
aatgctattgtatctgtagtatcttatttaactattttacaacttatccagtgaaataagtacctgtgtcactggagatttctctaggaatgtcccatgagagaaacacattttataataaccttttaggtactgtaatagagttaaccctcttgcatgggataccttctatacaaccagaaaacatgcattcaaaatgacaattgaatgtaatccttctataaatacttaaatggcccatcaggtagcagaaatgtacgtgaagttttgattgtcttcccaggattatggtttcgacaaagcaaacattggtcataaattattttagcaatttagcaatatatataaattttatatatacatgtaaaatttggaatattttatcttttccatgatgagccatggaatgcagactttttttttttgtttgttttagacagagtcttgctcttgcagtgagccaaaattgcaccactgcacactgcactccatcctgggcgacagtctgagactctgtctcaaaaaa

SEQ ID NO: 262995 - DNA, 297 bp, Homo sapiens
gtctcaagtccaatgactgagctacaaacagcagaacaaacctgtgtttcttcacaagcccattaaaaaaacgtgacagagacctggcctagctgcacagagggtggcccctactggaagcttgctgaatgaccagtcagaccggaattcactgtgcaggactcttttctttaatgacctccattcctgtggctgcaaagaggaggaaaaagccctggtcgggaaatcagcaccctgaagtggattctgagctttgaagctgagaggccttgaacaaatgattaaatcactctctga

SEQ ID NO: 262996 - DNA, 288 bp, Homo sapiens
gaagggaaagttgggactccctctgtccccagagaggaggggtgcttttctaggtttgtcaagttcaaggctctgatggggcgctctgatggggccacagctccagggctgagctctgtgagtgccctctcccttcctctctcctaccccctgccacagcgttaattgcaccagggttacttgaggcagccttgggcacctgtctttcttgtctcagatttgcctttccccccaccccacaaagttaagtaagatgagcctatcaacagctcaggtctagggactgtc

SEQ ID NO: 262997 - DNA, 368 bp, Homo sapiens
ctgttttaaaacgtcatatgtacatttccctcctcttcccctttctctccctagaatatgagaagggcctagaatgaaggactcagaggtttgaatgttcctattcgcttagcctggttgcgtgcttacctgtaaacctttgtgccgccccttttatgacagggacagctctgtatccctgccacattgcttttttactgtgcaatctaggcagtggcattgtattatatttcatgcgtatattatcttgtgtcacctatgtaattgactttttaatcttttcatgaccatttcctggatgtttcaggtatctgtctggagaaaagaaaaacatattacttgacatgtcattaaagtttgttaaattc

SEQ ID NO: 262998 - DNA, 493 bp, Homo sapiens
gaagcactgtgaggtaatagctctgtggaagcagcaagaagcgaggtaccttgaaactgatagcagagtcatttttgttacttgaggctaaaacaggataagccttggtgctctgggctttattcagttaataggttgattttctcattttcatgcctagggaattcactgttcttttgactgataaatctagagcagttaggcagttctccagagccaacagagctgacggtctttgtgtccaggttgctggatatgcattcctttttggctgcaaaccttgctgataagaaatatgactcactctgtggctgatgcttccagagaagtttgctgactgttttcctctcttctgtgtctctggagtccttagattttcaacagaagatggtcagaggaccaggctcagaaggtagagagagaccttccaggtgacatttccagaccaggtgcttcagtcatcattccagcagttaggttgttccctctaaca

SEQ ID NO: 262999 - DNA, 267 bp, Homo sapiens
ggcaacagagcaagactccatctcaaagaaaaaaaaaggttctcgtttgtgtgataaatgtttaccccgctcataagggaaacaggcataatggaaagtgtcatacagactaaccctgtaaccaggatccatgaatagaaattggaatggttggaaggaaaggctgtttgtagagtaaggtgcttttcatatgttgaattgaaggtgttgccaggacatctaagtcattattttctagtcggtaaaagtagctgagacgtcatttag

SEQ ID NO: 263000 - DNA, 526 bp, Homo sapiens
ggtaatatgaaatgttatttaacaaaataagaccatacagttggtttcaattattttcctctgttcattttgtagttcttagtaaggattttttttttattttcttcctttcatttgatagttttttatttataagatttttgaactgatgaagatgagtttgccttgttgctcctaattacagattagaaactttcttgatttcccctaccgattaaggcaaaattaaatacttcatctgtacttgctaataaaatactttttgaaaaacacttctaccatagtatttgtctcatggctttagtcatatttctcctagaccacaaccttactttagggatctttattgctattgcttggcatataataagtggtacaagaaaaggacaaaacttagtgataccagagaatgctaaagagtatagagaatctggtgggggcaaagtcctgtgaaacaattgaaatgatcattgatagcttaagatttagggagaggaaggttttacacagaaggcatgataggtta

SEQ ID NO: 263001 - DNA, 208 bp, Homo sapiens
tccgcagagaccctcggtccctgccggcgtgacggactctgctcccccgggttggagtcacctcgtccaggccactgcatcccccaagccccagctccgcgtccttccaggatcctcctctgcggggagaaaaactcgtctccgctcagcgccgggagcccgcctggggccggcgatcttcaaaagtaatcagagcccgcagtaaaaa

SEQ ID NO: 263002 - DNA, 638 bp, Homo sapiens
atacaatgaaatattattcagccttaaaaaacaaaaaaattttcagacattacaatatggatgacccttagggatattatgctagatgaagtaagccagttacacacaaaaaatattgtatgattccacttatagaaggtacttagcatagtcaaaatcatagagacagaaagtaaaatggtggtctccagggggtgggtggagaggggttggaagttattgtttaataggtatatgttttttgttttacgagatgaaaagagttgtggagatagatggtagtgatggtttacaacattttaaatatatttaatatcactagactgcacacttaaaaactgttaaggcagggcacgcacggtggctcacgcgtgtgatcccagcactttgggaggccaaggtgggaggctcacttgaacccaggagttccagaccagcctgggaaacatggtcagacttcatctctacaaaaattaaaaaaattagctggttatggtggcatgtgcttgtagtctcagctactcaggaggctgagggaagagaactgcttgagcccaggaagtcaagactgcggtcagctgtgttcgcaccactgcactccagcctaggcaacagagagagaccctgtctcaaaaatt

SEQ ID NO: 263003 - DNA, 418 bp, Homo sapiens
ggagtcctttactgaatgcgttctccttcaatccttccgacgacgtcaatttcagcggagtccctccaacctgttcattccaaccctcactgctcaggcctgaacttttctgaactagtgtcttccctgaccccaagaataatgattccattctctagaacaagcagttacagatccctcaccattaacagggggaaataggagttgtaaccaaggccttcggaatttggccttggtaatgttacagtttggatctctgcttcctaagactctgaaaatattacaaggtgcttttgtaactgtaggcacccagtgtgtgcttccctttggagcctgtggtatatttgcataagcaaagtagccatttaaaaggtgatttttttccccctgtgggcttgggggtagggatgggttcata

SEQ ID NO: 263004 - DNA, 405 bp, Homo sapiens
tgcatgattcatgtacttattcattcatccaaaaaatatttacagggcattaaacatgtgctatgcattgaggtatacactgggcatggagtctagttcgaaaacatgtgagtgcagacagaccctgtcctaagggagtctaccaggtgaagatgagcccacgtaaaacttccattgtgtgcaggactaagaccaaccttattttcatggcacatggaattgttcataatttttctgcaacctaaccttcgagcctcacttttgtccatccactccatgtaccgtattttatagacaacatactgtcctatttgcctatctccttgacatgttatgttcttctaaactttcttgactttaagaaagctggtttctcttgcaggatatttgcataccccctctatt

SEQ ID NO: 263005 - DNA, 509 bp, Homo sapiens
ccttattcacactgccttttattgcagctgcattccagccagctggaggtggcctggctgcctcagctttcccgatttagctctggaaatgacttcagcatggcaaaaacgtttcactggccaatttggaaaacaggattcaatttgtgaagaaagctcaaaatggcaactgagaatgaaaaagaggatggagaaggttgcggcagcaaagcagtaagggaacagagatgggccgggtgcagtggctcacacctgtaatcccagcactttgggaggcaggcggatcacctaatgtcaggagttcgagaccagcctggccaacatggtgaaaccctgtctctactaaaaatacaagttagctgggcatggtggtgggcacctgtgatcccagctactcaggaggcagaggcaggagaatggcttgaacccgggaggtggaggtttcagtgagctgacatcgcgccactgcactccagcctgggtgacagagtcagactccgtctcaaaaa

SEQ ID NO: 263006 - DNA, 514 bp, Homo sapiens
ttgcttgatgccaggagtttgagaccatcctgggcaacaaagtgagattcttactctacaaaaatttttaaatagctgggcatgctggtgcacatctgtagtcccagctactcaggaggctggggatggaagatcgcttgagcccaggagttccaggctgcagtgagctatagttacatcattgcactccagcctgggcaaaagagtgagacttgtctcaaaaacaaaaatcttacaattattgagttgtaggaactattctaaatacatagcttctcatttaagcatcacgatggtgtcctatgagatagctactattgtcatcttcattaatgaggaagttgaggcacagaaaggctaagaaatagttggtaagtgacagggtttaaagtaggactcaaaccctaattgaactgaatccaaagactgagctctttctattcaaataggctgctgttttcattaaggcaatgagcaatcagagctagtaagtattgtactttcttcaaaaaaa

SEQ ID NO: 263007 - DNA, 224 bp, Homo sapiens
aggtgatccgcccgcctcagcctccctaagtgctgggattaaaagtgtgagccactgcacccagcccgtgcagtcacactttaataaattttgtaaggttacatgaagtttctttgaggatccaagaattctgttttctgagcccaagggaggaatgatgcagacagaaaagattggtaaccaacactggggagcgaggggcataaaggagatagtgctgacct

SEQ ID NO: 263008 - DNA, 313 bp, Homo sapiens
caaacttctagcaagactgacaaagtaaaaaagagagaagacacattaaatagagaatacacctatacctgcagagctcaaggggataaaaagggattactggacacaactctacagacacatacatttgacaacttagatgaaatggtgaaagactgaatgatttccctcctattatcaaaaacaaggcaaggatgttagtcatcaccactttcgttcaatattgggctaaaagttctaggcagtgcaataaggcaagaaaaagaaataaaagtcatgcagattggaaaaaagtaaaactgtccctttttac

SEQ ID NO: 263009 - DNA, 397 bp, Homo sapiens
tttattggatctcatttctgccaaaaaaaagtatatatgatgtacatgtgtatatatcagtgtagaaaagtagaacctcaaaaagtatataacacgttaacattgttgaccctagagaggagagtgtgtattagtccattttcatgctgctaataaagacatacctgaaacttggtcatttatacaggaaaaaaggtttaatggacttaacagttccacgtggctggggaggcctcccaaacatggtggaaggcaaggagcagcaagtcacgtcttacattgatggcagcaggcaaaaagagagagcttgtgcagggaaactcacccttgtaaaagaatcaaatcttgtgagacttatttactatcgtgagaacagcaggaaaaatctgtacccatg

SEQ ID NO: 263010 - DNA, 519 bp, Homo sapiens
ccttaaaatgtatcagaacttacgcacacactcgatcacatacatggcaccattcacagtctagataaatagaaacaaatgtaaacaatacagtataaatcgtaattggataaaattaactgcattacctactatactactgtaataattttgtaaccacctcttgttgctattgcaatgatctcaagtattgtgagtatccatttaaaatgccatgtgaccctaatcatgtcacagtgaacagttcatccagtaaattgtgtattgcagtaaaaagtgatctctctatgtccttgagtattttgcatcctgtttagtgcaataacctaaaccttaaataatgccataagacctatacgaagtaccactggtggtgccagaagtgttccccaaagcagaggcaagtcataatgttataggaaaaatttgaattgcttgatgtatactatagattgaggtctgcagttatagttgccatccatttcaagataaataaattaagtgtaaggacgattattt

SEQ ID NO: 263011 - DNA, 534 bp, Homo sapiens
agacccttcacgtctatactgtgtctctgtctctgtctctctctcttctctcaaaacaggctctcactctgttgctgacctctcaggctcaagcaatcctcccacctcaacctctcaaagtgttgggattataggcgggaccactgtgccggttttgttttgttttgttttgttttttaatagagatgggggtctcactatgttgcctaggcttgtcttgaactcctcggctcaagcagccctcctgcctaagcctctcaaagtgtagccaccatatccggccctaaatgagttctttttgtattccgtaatttttagagttcaccttaaattttacagtgtctatagattgataaatttgcttgatacttaactcatgcttaaaattatcacttcctccgagacaactgaatgtaagtttggatttttcaaaatttttccgtaaaataaccatttctaaacatatagcttaatggtcaaaacaagtgcaataaaagattaatttacaagtatcagaagtgaagactgtggtcc

SEQ ID NO: 263012 - DNA, 249 bp, Homo sapiens
gtactataataatactctctatattaacatcaaaaccagtcacttgatttgatctgaagaagacccataacattctagtcatccagtttgaattctatggatcatttcagaatgcccaaataatctagggcattattggttttagtaatgtagcaatctggtacctacaggaggaggtacgaaacttgatgtataactaattgattggcttaatgttggcaagattacacacaagggtcaaccactgac

SEQ ID NO: 263013 - DNA, 1073 bp, Homo sapiens
ccttccctcaccccatgatatctgtacctaaaaaatgtcagaaaagtcccatttttgtatttacattttttttttgtgaatgaaaagagacaaaagattctagactggaaaggtgcctggcactcagctggagcactgccctaggcggaggaagagatgcagaatatgatggggctcccacctctgttcccgtcttcctggtccctctccccttctggaggtgactgagttgctggtgtctcatgagatgtgataaagcatcctggttaagagcactggagatagtatccagcttggctttccatcctgttatgaattggcagattaaccttggacaagtgatttgaactctgcctcagttcttaatctgttgagtatgaagaaaaatagacctacctcccagggttattgggcagtttaaatgagttaatgtatacaaagtatttacatcagtgtgtggcacccagggatcactgtatgagaatttcctgaacaacaacaacaaaaaaacccttctagaaatatttttacaaattatgaatgtattttcctaattttgaaaatacaactagtagaataccatgaatactgttctgcaccttgcttttatttatttatgtatttagcttgtttcttagcaatgtcaagccttatgttccaatttgtgagctatagtgttttgttaccatccctgtaagacaaagcatctaaagtaatcacctaggtatgcatacggaaaacctttctggactgtcagggaaagcattttatcccaactgccctgaacttgtcactcttctctgagcaggtcacaccccttgctgactcagcctttgtactgtgttctctgccttgaattcattctctcttctccacgctacctggcaaactgtttttcctccttcaggaatcagctgaagtatcaggattgccgtaaagctattcctaactttctccaggctctcctgtgagcccccctagcattgtgtgtctgtctgtgagccagccttggcacacagtgttgcggttatgatctgtgtatatgtgcacgtgggggcccagagctctcccac

SEQ ID NO: 263014 - DNA, 545 bp, Homo sapiens
caatgtgtatacccatgtaggcacaagaaaaatgagtgaaagtttttgctacaacattaaagaaaaaactgaaaataacctcaatgtccatagacaagaaatatatattagtagattaatagaatacattactactgagtagctaaaataaacttaagctacctgaatcaaaatatataattctcaaacagagtctaaaaaattgcatgaggatatgtatagtatgaggtcactatataaagtaaacatagcatattatgctgtagctacataaaatatgtagtaaaagtataacaacatgcatgggcataataagcatcaaattcagagaaatgttcacttctgggaaaagaagaggatgcaggatcctcggtgatagggtatttggaatgttttatgtcttatttcaaaacatcaaatgctactatgtaaaaatgctgggtggtgggtacctggatatttgttgtattatcctctgtacttttctgtctacttgaaatactgaataataattaaaaagaaaatacaagcaagcaaaaagaaaa

SEQ ID NO: 263015 - DNA, 404 bp, Homo sapiens
agagagagagagagaggaagagctgtcttacaatggctgcttaatttaaatttttcaacaaagacacataatgcttacataatatatgataagaatacttctcacttccatgaagaaatatgttctcaggccgggagcagtggctcacgcctataatcccagcaccttgggaggccgaggcaggtagactacctgagatcaggatttcgagaccagcctggccaacatgacaaaaccccgtctctactaaaaataacaaataatagctgggcgtggtggcaggcacctgtaatcccagtgactcaggaggctgaggcaggagaatcacttgaacccaggaggtggaagctgcagcgagccgagatcgtgccattgcactccagcctggtcaacaagagtgaaac

SEQ ID NO: 263016 - DNA, 271 bp, Homo sapiens
actacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaatta

SEQ ID NO: 263017 - DNA, 658 bp, Homo sapiens
aaagcagacagtattattgttgggtttgatcctataataagaggaagaagtaaagacagaagttaggagaagtataagggcaaacagaagtttcatgtatcccaagtaacgaaaaaataaaggtcctaaaaagagaagaaaagatctaggctgtatacaggctgggactgggaatgactggtggagaaagaattagccgttgggggcacagacaggaacctcaggggagtaacagtaatactgacatttatggaatgctcagaaaacatcagggactcttctaagtctccttaatgtattaattcattgaattctcacaggaaccctgtgaagtatgtctatcattatccctagtttttaaatttaaaaaatgagataaagtatctgtctgaggaggaaggaattcaatattacatatgaatttatatttgaaaaaatgtgggggagagacctattatttctgtaatataaagctaccaggaagaaaaacaccttcttagggatctctaaaatcatcatggatacattcctaccagtcatgaataagaggcagttgcaacggtggaaatgagatttttaggtttttccaaaagtagaagtttaagttgaaaaacctcagttctgggatacagcatcagagtttattcactgccagtgg

SEQ ID NO: 263018 - DNA, 470 bp, Homo sapiens
gccttgccagccccagctgaaccacttcagagagccattaacctctgcaaaacggagtggacaacttccacgtggctttctgtagaaatcagatgggactgcaagcaatggcacggcccctgccaaggtggatcttggagcctccagaagagacatgggcagagacctccctggtcttcctgcagctcctgccctggaacctgagtctcccaggcatctgaccagctgcactccaccaccagaagccggttaccaccgtccttcgggctttgtcctggagggtgcggggctggtgtggaccattcagtctggcagtgaccaccacccagtcagaggcacggcagaacgcacctgctgcacggacgctgtttgaacttcttcaaaacgtggtgcagtgtttcctgaagacatttaccatccttggcagttaaatacagcacagtgtcaattacaggtccatcttctgtaag

SEQ ID NO: 263019 - DNA, 234 bp, Homo sapiens
atctccagtcagctctccacacagcagggaaggggctttccataccttcgaaggaagggcctgttgagcctgcgttgctgaggggctagacggggcccatggcggagggctgccttcaaaacagctgggtgcagaaattatagcttcctagtgatgatcggccccactttgcgtggcaacacaatatgttcctaatgactgaattgtttatttaataaagaaatcacaaccatt

SEQ ID NO: 263020 - DNA, 936 bp, Homo sapiens
gccagcagctgattagctggtgcccacccagattaagggtgggtctgcctttcccagttcaccgactcaaatgttaatctcctttggcaacaccctcatagacacacccaggatcaatactttgcatcattcaacccaatcaagttgacactcagtattaatcatcacaggtgggtgtggggttggatggccttccagaagattctgttctgagtgaccttgggaagccaggctgtgacgttggaatgaaggtccagagatgactgtgtacgaagggaaggtcgaatgtgggtgggcaggggacagggcttgctgtgtttctggcattcaatgtccactgtgatggaggaaaaaaactcttcctgaattccagggggaattttgagtgatgtcaggagaagcagtcacacaggtgtgcaatgcatgtttgccaagacagccgcataagccatcggcaggaattaaggtacaggaagggcttcctggggtactcagttgggaaaggggtgctttggagtagctgggagggctggagcacttagaacacttagcccgctgggagtcactccatggacagaacatgataaggcaaaggccacatggaggacctgaacacctctgggtgacctcagacagtcacttctggtctctggtctccgtctcctgttcaatcatcaaagctgtttaccgacttccaagagtcactgtaagtcccaagtgtggcgacaggcgtgcaggaaactcacacactataaattccctttcaaaagtcaagaggaagccgggggagtggacgttggtctagactgctgtgacatttctgaagctcctctgaaaatccaccaccatccgcactgtgccaggaagagcctctgtctgaggacagccattgagaagtggacaagagtgggtacatttacaatttgcagagaggag

SEQ ID NO: 263021 - DNA, 445 bp, Homo sapiens
taaacacaaacccccttgagaatcacgccgacaggtgctatctcttcacctggggattgcaaaggaagtgagaacatccccgagcaagaccaaaaattgctgaataaacacaaacccccttgagaatcacgccaagaggtgctgcctcttcacctggggattgcaaaggtattacagcactgtacagtttactaaacacaagtcttcacatcagtcctcttctctgcagccacatgactcaagcaggcacaggacccatcaggaacaccagagtcctgagcaggaagaatgtctcctgtcgcagccttggggggagtcaggcatgatgtgcccgatggtgcagcaggacacgatgatgtcagagctgcctgggacatattgaacttcctgattttttcttcttgtgatggaataaatgattttggattaagatggagagaaacaa

SEQ ID NO: 263022 - DNA, 560 bp, Homo sapiens
caagtgttagggagattgaaaaactgaaagtttttagcagagtgcattttccttcccctaaatagtgttatgatgatcacttttgatgaacagaatgtggcagaagtgaagatgtcttaaatattaggacaaaaaaaggtattgactgtggctttctcattgctctttctcaagtcagttattctggggaaacccaactgccatgttgtgaggacactcaagcagccctatggaggagcccacatggtgaggtactgaggcctcttgccaacacccatatgagtgagccatcttggaagcagctccagctgacatcttaattacaaccccctgagagacctgtatcagaactacccagctaatctgctccaagtttctgactcacagaagctttgagaggataattgttttaagctgctaaatttggagctagcttgttacacaacaataataactaatacacttagtagaaataagaatgggttcacgaaacatttcagttgtatatgagtgtgtgctaggtctcagtgtaaaatgaaccccttcttataggttgcagt

SEQ ID NO: 263023 - DNA, 787 bp, Homo sapiens
aaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctggaatgagtccacgttaccctaaggacagtaatcccaaattgagacaaaaactttaagaaaaccaatgtttggggccaagcaatggggagcttggccgacctcattttttagtgattttgaactcaatctttaaaatcctggaagagaaggaaaaaaagggtgtatattcgtgtaatgacatccagatctcactgttctcttggctcctagtgatgggggaaaaaaggtgcgcccagggttgacccttcagtaacacctgcagccatgcgtcatgacctccaggtgttcagaggccctgcccatgtgacacgtgcctggtacttcccatacatgtgcctctttaatcctaataaacctggggtgaaatccggctgtgcctcttgctcgctgtgtgaccttttgactttaagttccttaacgtttctgagcctcacttttctcatctgtgaaatggggatcattcctatttctaagaattgaaagcgcacattctcaaacttcagtgtgcccctgaggcatgtggtgtgcttgtttaaaaggcagatttctggacctacctctaggaattcagacttaggaggtcttgagtggggtcc

SEQ ID NO: 263024 - DNA, 597 bp, Homo sapiens
tcattttatgcccattcagagcactgcgtgttttgaaatatacaaatagtgggaaacgaaatctttgttctggatgcagttataatttggaaagcgaggaaataaattataacaaggggaaaaaacagacacagagggattgaaatgcataacaatagagatgaaacacgaagagtgataaatgaagattgagtgtgcacaccttctggaggagccctgattgagtattttaaaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccactatgtttttggatttgttataagtttatagataacaagaaaaagttatattagcatggtaataaaattatggatatgtgtaaat

SEQ ID NO: 263025 - DNA, 528 bp, Homo sapiens
agcatggggcctgataaatagtaagcccttggtaataattacatcttccgtgatgctagacacagagggattgaaatgcataacaatagagatgaaacacgaagagtgataaatgaagattgagtgtgcacaccttctggaggagccctgattgagtattttaaaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccactatgtttttggatttgttataagtttatagataacaagaaaaagttatattagcatggtaataaaattatggatatgtgtaaat

SEQ ID NO: 263026 - DNA, 507 bp, Homo sapiens
aaagataaataattatggtagcttgtctccaagatggctgaccagcataaatttcttctccctatatccacacaagccagggttgcagtttattcctttgttcccttgaatgtggcctgatttgtgactgctttggtcaacagaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccactatgtttttggatttgttataagtttatagataacaagaaaaagttatattagcatggtaataaaattatggatatgtgtaaat

SEQ ID NO: 263027 - DNA, 492 bp, Homo sapiens
tcattttatgcccattcagagcactgcgtgttttgaaatatacaaatagtgggaaacgaaatctttgttctggatgcagttataatttggaaagcgaggaaataaattataacaaggggaaaaaacagaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccactatgtttttggatttgttataagtttatagataacaagaaaaagttatattagcatggtaataaaattatggatatgtgtaaat

SEQ ID NO: 263028 - DNA, 420 bp, Homo sapiens
tatgtcagctgttctccagagtatactcttcattgattttccaatgatagcagcaaagaaatagtgaaacttaatcctctgattttttaaactcagtgtttccttatatattttttttcatttctaggttccattactagcatagggaataattttttgaaatcttgcaaggaataagaattttgctttttaaaattacctttctgagacacttcacttactgactggattattctcatttttgttaaagaaaaaaatgcatttaagccaggcctggtggcttgcatctgtaattccagctactcaggaggctgaagtgggaggataggatcacgtggcctcaggagttggaggctgcagtgagctgtgatcacactattgccttctagcctgggcaacagagtgggaccttgcttaaaa

SEQ ID NO: 263029 - DNA, 600 bp, Homo sapiens
taggagctggtacatgacatttaaaaccatgggaatgaatgagatttcctagatagaaagaagaaaagaatattgacatttaatgttgaacggagtaggaggagctgaacagggagaccaggaaggagcagacagtgaacctggagcatgaataggagagtgggtgtcatggaagccaagagaaacaagaattcaagaaagaaagtttcttactgtagcaaatggcgctgagagggaaagtaaggccatggaatgatgacaatgacaacagtgacgaaggatcattgagtatggtatcatgctgacatttgtttctacccaggctaggtcgttactgaggggtggtagctaagacagggtgggttgaacatgaggaaatgaagacagaacatgggatccaagaggtagcatgaagagattattgtacatgccccaggactttccaaacctcttctttccttccatcaaccatctctcatcctggaatccacccctctaaccttttctaataaaattactgccttaaagccaggacagggagacagatttgagctggaatcctgtctaattgttaacttataataaaagcattcttttctc

SEQ ID NO: 263030 - DNA, 652 bp, Homo sapiens
taggagctggtacatgacatttaaaaccatgggaatgaatgagatttcctagatagaaagaagaaaagaatattgacatttaatgttgaacggagtaggaggagctgaacagggagaccaggaaggagcagacagtgaacctggagcatgaataggagagtgggtgtcatggaagccaagagaaacaagaattcaagaaagaaagtttcttactgtagcaaatggcgctgagagggaaagtaaggccatggaatgatgacaatgacaacagtgacgaaggatcattgagtatggtatcatgctgacatttgtttctacccaggctaggtcgttactgaggggtggtagctaagacagggtgggttgaacatgaggaaatgaagacagaacatgaatttttggaaagtttggctacaatgggaagtagagaaatggggtaatatctggaaggggagggaattgagtcagtagggttttgtgttttgattttacggtagggcatctagatagatcatgtttatgtacctattcccactctgttctctcttcctgaagagtctcctctggcaaactccattctgtaaacgtccgtatttaagtgtcctgttctctgtcaaacattcttcccaggcctagtatgatgtttgtcccc

SEQ ID NO: 263031 - DNA, 389 bp, Homo sapiens
gctggagcacactgaagctggagcacactgaagtggaagatggggctgcagacagagactgggcagcctctgctccagggaggcccgagagccagagagcagattccataagaagaataactcccattcctcatgcatgagaccctctgctaaatgcttcctgtgcaccacctccagaaatcctcccaagccaggacaccagcagtattacaggaactggatgacaaaaagaagagccgatataaccaggaacctactctggccaccccaagtaaggatctaaagtccagcctcctcctccactgccctcaaggcctttcctcatgaaagcagaggttctgaatgctgatttctgttttaaagcccaataactctttaaacatctaaag

SEQ ID NO: 263032 - DNA, 270 bp, Homo sapiens
tgctggattccattatttctgtttaaaagttacactatcttatacattgagctttttttaatgtagtaagtaaacagtttttcttgcccagtttttcttgcccagttttttcttgactcagtatgtcaaaaaaaaaaaggctgagagcaaacatatgactgttttgtagtaagtactctggaaaatgtctgaatgataagtgtggatacacatgaggaattaaattacattttccagactaacaaaaatataatcttgggcttgaatgat

SEQ ID NO: 263033 - DNA, 323 bp, Homo sapiens
aagacccaacccatcatcccagagattaccaggctgcactgacaggcatgtaggttggagaaagaatctgaattctatgttattagtagttttaagaaatcatcttttctgattgatcaatgcactttaacccataggactttctatctggtcctatgttttataaatttctattaagggtgagggttggccctccttagggtgtccagcatttagaacaccaaaacagattaggtttgcgacactgattctttcaacataactacaaagttttccaggactacaaaatttttgaagaaacaatggttaaaacccacaagaaa

SEQ ID NO: 263034 - DNA, 410 bp, Homo sapiens
atttctgtcttgcagtgtctcagaaggctttggggataagctgaccctcaaagaccaggagaaaagatcacaactggtgaaggaacagaggagggcattccaagcatggcaatcacacatacaagtgcaaagaggcatgaagccgcacgagggacttcaaggaggaggctggatggggacacataccatgagtgacatcttaccagagggtggccatgaacttcatcatgttccacaactgttaatgaccactggcgctggccctgctgctctctgaactcctctctgtggaactgtgccccttctctgggaagagtccttgaagctctactgagaatgaaacctcttctttcagctcatgtcaatcttgaatcttgctctgttgcccaggctggagtgcagtggtgtga

SEQ ID NO: 263035 - DNA, 398 bp, Homo sapiens
ttcctatgaacaaaagtgaaaagtcaatccacaagaatgggagaagacatttacaaatcatacctgctaaggtactgttacccaaattaaagaactctttttaaaatttatttataggccacgcacggtagctcacgcctataatcccagcactttgggagactgagccaggcagataatgaggtcaggagtttgagaccagcctgaccgacatggtgaaaccccgtctctactgaaaatacaaaaattagccaggcgtggtggcgcacacctgtaatcccagctactcaggaggctgaggcaggagaatcacttgaacccgggaggtagaggttgcagtgagctgagaatgctccccttcactccagcctggggggcagggcaaaaatccatttcta

SEQ ID NO: 263036 - DNA, 421 bp, Homo sapiens
gtcaagcacgtgagaaaaccaacattgtttgagggtctactatatgccgagcatggtatacattttttcttatttaacctgacaacaacattctttcccctgttttacacaggaaagttgtttaatcttcctgggccgcagttcctcaaagacgcttgcatgatcattggaggagccagaaatgaaatgaagctttacctagcctagaaatatgttcaagttaatatttgctaaggctttgtcatgacacagagaagtacagtttctggaaatgaatttgagttctgtcctcaggactctgcccagagccacctttgtgaggtcctataattagaagggctgtcagagggtctctactctaacttccactcagatagccatttcctctacctctgcctggagacacccagtaatgggtagc

SEQ ID NO: 263037 - DNA, 615 bp, Homo sapiens
cttgtctaaaagggaacatgtcatcttctcccaaacctgttcctacctcagtcttcatcttccctcatgaatgacactgtcatccacccactactcagaccaaaattccggaagtcatccttaacatggtctgtttattaccttccacatacaaactatgaccaactgattctactgccaaaacaaaccaccacggttccacttttaccacctaaaaacattctcctactatcaatcagatctcctatgttatacttctaacatatacacaactcaacaatcaaatatcagcattttgctttatttccttctgtccccctaagtattatacatagactttagagttcctatgaatcaccacctgacccttcctttcccagatataaatacttactaaattagatatttcctggccaagcgcagtggctcacacctgtaatcccaggactttgggaggccaaggcgggtggctcacttaaggtcaggagttcgagaccagccttgccaacatggtgaaaccctgtctctactgaaaacacaagaattagcagggtgtggtggcgggtacctgtagtcccagctacttagaaggctgaggcagaagaatcgcttgaa

SEQ ID NO: 263038 - DNA, 523 bp, Homo sapiens
gcagcttctagttgcagctcaagacccgcgagttcaccctccgcgccaagcacccaactcccggctctgcctacagtcacccacagacctaatgatcgactaagcgccgtaatggcccgagatgacaccaggagactcccttgctgtgcgcctccggaagacgcggaacgtagcccctttctcacactcctgggacacaaaaatacccgacaactcaaagtcgccaaaccacatcttttcatgctttgaagacttctgcccaaggctgtggcaggagtaccctacaaggtttgcacaaagcaagaaagcatcatgtaaccgaaatgctgaaaagtatagatgctgcaaaacctcattctgagactgagaactatgaatagtcagtgtatttccttctgcggtgcagaaaaagaacaaccaaaaagaaagcaacaaggggagatgttatttattttaatgacaccaaaactaccaatcctagcaatttaataaattaaaatcatagtcctttaaatgtaaataa

SEQ ID NO: 263039 - DNA, 1047 bp, Homo sapiens
gcagcttctagttgcagctcaagacccgcgagttcaccctccgcgccaagcacccaactcccggctctgcctacagtcacccacagacctaatgatcgactaagcgccgtaatggcccgagatgacaccaggagactcccttgctgtgcgcctccggaagacgcggaacgtagcccctttctcacactcctgggacacaaaaatacccgacaactcaaagtcgccaaaccacatcttttcatgctttgaagacttctgcccaaggctgtggcaggagtatgtccaactgtgatttgggattctttttaaacatcgaatcaaagggaagaggggagggattcgcaactaaatggtagttgttttcaagcaagtctttacgtagccccaaacctactctagtattcggtgattcagccccaaaacatctctgcctgcctttatgttcggatctcactccattatttgtcagcaccaagtactaaacccacaaagcgatcgctgtacgggacaccaaacccatacctgcccgtcccctaccttccaggcaaccagtgtcaatctcctcactatacataattcccaacatccctgcccgaagtgaggagaacggtaatttaaataatacagcgggggaggagaggacacactgtttttgaaagactgtaagcattctgctgttccactctgcgtccttacacttgctgagcactgacaccaaatttaaatggcgttccttcaaaactgatgtaattgtaaagagctgtaaagggcaatgacctcaagtggatgttttttcccaggtaccctacaaggtttgcacaaagcaagaaagcatcatgtaaccgaaatgctgaaaagtatagatgctgcaaaacctcattctgagactgagaactatgaatagtcagtgtatttccttctgcggtgcagaaaaagaacaaccaaaaagaaagcaacaaggggagatgttatttattttaatgacaccaaaactaccaatcctagcaatttaataaattaaaatcatagtcctttaaatgtaaataa

SEQ ID NO: 263040 - DNA, 515 bp, Homo sapiens
caataaacatacaagtgcatgtgcctttttggtataatgatctatttttctttgggtatatacccagtaatgggattactgattcaaatggtagttctgttttaagttcaaactgctttccacagagcccgaattaatttgcattcccaccagcagtttataagcattcgcttttctctgcagcctcgccggcatctgttgttttttgactttagtcaaaaaatagccattctgactagtgtgagatggtatctcaatgtggttttgatttgcatttttctgatgattagtgatgatgagcctttttcatgtttgttgaccacttatgtgtcttcctttgagaagtgtctgttcatgtcatttgctcatgtttatttattttttgaatgatttctataacttttttattttgatctgttctaacattcttttattatttaacatgatgaaattagatttctgtatagtttctctactataattaataaaaaccatttcggcttttaaaattctca

SEQ ID NO: 263041 - DNA, 406 bp, Homo sapiens
ctcaaaaacgtatttcctggtagattgaggatgtttttacaatataaaagcaacgaccccctaaagtcaagaattgcagtatttcttcaccttaaccaatcataagagagataaaagaactgttcctttgtgaatggtacaagttaattaccacagtctcccctatgatgcttttcatttggtttggtaatttttctaatactttctccttgtaaaagctaaacatcccacagttttctttttaaaattctttccttttaccttcatgtaaagaacttacattgaatttttaaagcatctatatagctctccatttttctacaagttttaagtagactgtaattattacaagacattggctgtagatcaggccctgtgcaggccaaatactgtaaacaccccactg

SEQ ID NO: 263042 - DNA, 556 bp, Homo sapiens
ttgacacattaacaatataatccaagaagcacttgagacatatcacagcttatttccagccatgacttggagccagatggccttgccagtgactgtgttctcatggagcatatatactcatttgtttacttttttcataagtcagtttaaggttcctcatgattcttatatatttatttttatcagattgttttgcaagtcttttatctcctcctgcaccaatgtaccgttttcacaaatgcttggatcactttcttggtttagaacagctgcttttgcagagggcttgactggaagtgtatgtttctgtatgtctgtctgtgtttgtgtatgcaccatttttattcagacatgtttgttttttatgcagataaatataataaagtggacttttgtgtgtgtgtatgtttgaatttgttaatcagacttcatagtctcaaatcaagagtgccaatgtagcttctcaaaaaaatgtcaattcacatatcttggtggccatgtatatatttaatcattaaaagttccagtatcattttctcttgttgatggtgtcaac

SEQ ID NO: 263043 - DNA, 432 bp, Homo sapiens
cgagcacgaggtgagaagcctgggaggtttgagttctgtctccatgaccataagtctgcagccacacaattgtgtgatgggttgtgtgatcttcctgacaaggaaccagttgaaggatgctgactgggaagccgtgcacgcgaccggccgtcaggatgtgcccgagaaaattaaaaacattaagtactccatccggacacaaagcgtctccatatgacagagttttgttactgtggggagaggacaaagcaccagccacacccctcattccacagcctttcccaaccctcccctcgagatgaaacactggccatctgcagcgcttcacctctgagctggaaagaagcttgtttcttttgctttgatgaggttctgctggttttggcgggactttgaagtttatttattgtcattaaattgcattaattatta

SEQ ID NO: 263044 - DNA, 420 bp, Homo sapiens
aagatggttcgctccattaactgcagtttgaagacaatgagaagagaaagtctcagggtaaacggacaataacactcttttatggatgtggtacatcacaggagcctgcagtggacccatggagaaacagctcagcagacactgaagctatggggtctagggtccaggacagagggcctgcctggagtaatcaatgttgggagctgatgctgggagaacagattaatagattaagtcttccagggtgagaaaaaaaaaaaagggcagagtttgaaacactggtcaccaccaacatttaagccaataaagggtcgaaggctaacaaagaaatagagaaaaaaatcggcgaagagggttaggaaaactaggaaatgtggtcttttagaagcaaaagaggggaaagctttaagaagagatggg

SEQ ID NO: 263045 - DNA, 482 bp, Homo sapiens
attccatctagactgatatattaaaggatacttggctgaagaaatgagttattggaaaaactaacagagttggatgttatagacttgatctccccagatcctagtcttcccacccgagacagccagactgccttttgggtcaaacttctgaagttgtgcaaacgtatggacaaattaccatgagctgacaggggcagcctgaccatttcctcacataaagtggcttttgtgctttttactttggtgtgctattaaatgaatttgtgctataaagtccagtcaaaacagcagcactaattgaatataatctcatctttgctttgacaggatgcagttttatcaaggcagaccagtttagttctcttatgtgcattttggttagaaatttattattgtttaagaattacagatattattcctaaaatagagtgctaaccactgagagcatgaggtggcagagcaggaagagtctggaactggga

SEQ ID NO: 263046 - DNA, 440 bp, Homo sapiens
gtgattttggggccccaatatttattttctttcaaatttttctccttttctttttaaaaatatttcagggaaagcattttagaagaaaatgagtctctggcctcaggcttcctctaatccctcatggctaagaaggttcattcctagatggatatgtccagagttattaggaaagctaatatttagcaggttgtgaagtctcacatcctatgaagataaaataggggaaggaagggagaaaaacaacaacaacaaaaaagaacagtcctggaaaacttatataggccacattattctgaagttaatatatcagtaggcaggtatgaaagtggcttatgtgtgtaaataggttgctgttattttcctctgaagtttaatttgtctagcatcagtttgcagggctttgtgaaagcacagctaagttctcagttactccaaat

SEQ ID NO: 263047 - DNA, 421 bp, Homo sapiens
gaaaataaaggcttatagtctcataaccaaatttgtaagatgtatgtgttcatgctaaagaatttgacctttcttttgatttcttctttttacctttgcatgttcacagccacaatataattaagtcagcttttttcctttctttaaactacatttttttttcctgtggtgtcctagagcctacagagggaattgagagagatgcttagaaactggcaatcctagcatccgcccttctctagaagtaagctattaaatgttcaaaatctggctctgtaggtgaaaaaatctttaatttgtagcatttgctgagttctgtggtgcaaatacaccgaagaaggccaatttcaagctgccagcataatgtcactgaaaacagagctgggaggagatgtgtattttcaccccacagatacgatat

SEQ ID NO: 263048 - DNA, 941 bp, Homo sapiens
  misc_feature (147)..(147): n is a, c, g, or t
  misc_feature (241)..(241): n is a, c, g, or t
aggcactgaagtacttgatactaattggatattatgaccacttttcagcaattgtattactgtaatggtgggatccataaaggaaatggtaaacctgtcttatatgggtagttgtgtgaattgcaaaacttacatcaaataattttnttgcctcgtcttttgaacaagtcatgacatcattctagttcctttttcaacttagtgagatgtctgctctgtgttaatattataatgtgtatantctacaacagaattgtcctccaaattgcaagttttcctttttgaatctaatatatcaggctcatttttagatgacttagatgcataaggattttatcgtagcttgatgttagctctctgtaacctttcaggtatattaatcaaaaaagccaaacttaataaagcatctaatttaaaatggattgatctcaaatattttatagccactatcttttcacaatagtaaaacataaaagagtttaagctatgccaatttagagagtgcttaacaatgtgtaattactttattttcacttaatagatttttacctgtgccttgtttcagatctgaataggtttcctttgacctcaaaatcactaatgcagggaaaattaccatatcatgagagtatttttcctctttcttttttttgcctgatgcttagaataataaatactcccaaggcttaggagtagacatggcctgagagaaagcctattaaatgctattttctaatggttttaaaaaacaacttaaacaaatcatgctactcaaactgattttcttgctaaaacagaactagttttagagtatattttagacatctttttttctcaattactagttaaacttgaagttgggctctatctggatttgctttatagatctgcttcatttcatgccagatttgggcaaaccatgaacaacccccaactccagg

SEQ ID NO: 263049 - DNA, 492 bp, Homo sapiens
ttggttgcttatgtttcctcaaagggtaattttaaaaattaaaatcgtatatatttcactacaaaagtgataaagattcccagaacatttggaaaaaacaaaagtaaaagtaggggctaaaatccttccaccaaattctgttattactagtgcatttcattcttttttttcttaatatacgtagggctattttttttttaattaaggaaaaaatgtaaggccaggcacaatggctcacacctgtaatcccaacactttgggaggctgaggcgagagtatcgtttatgcccaggagtttgagactggcctgggcaatatagtgagtccttgtctctacaaaaaattagccaagcgtgatggagtacacctgtagtcccaggtcctccggaggctgaggtgggagaagagcttgagcctgggaagcagaggttgcagtgagccgatatcatgtcactatactccagcctgggcaacagagtaagaccctatttc

SEQ ID NO: 263050 - DNA, 223 bp, Homo sapiens
tttagtagagacagcgtttcaccatgttggccaggctggtctcaaactccgggcttcaagtgatctgcccgcctcagcctcccaaagtgctaggattacaggcatgagccactccaccctgcagaagtcagtatttgtaaaaagtgttatttaaaaagtaaaacaagacaccttgctccaaggccactgtaacatgtagtgaaagcaatagaaaaaaaaatag

SEQ ID NO: 263051 - DNA, 204 bp, Homo sapiens
tagttccctttcaaaatgggctttcagtagtgggttcattccttcctgctcttctgctatgtgaggacacaggtccctctcctccagaggacacagcaagtgccatcttggcagcagagagcagcccttgccagatgctggagccttgatcttggacttcccagcctccagaactgagaaataaatgtctcttctttataaatt

SEQ ID NO: 263052 - DNA, 804 bp, Homo sapiens
agattttcattaatgttatggtgatgaatctttcataaacaatacttaccattgattgtgcttttcttagcctagttctgtcctgcaatttatctttcttatcatgtgactgtcggctgaagtctggggttatttggtttctttttcttcttctgtaaattggaaagcagtgggaaaattacaaagtatctttttaaaactcaggtggtttgcatagctatttgtctgtttgagtttgttgttcctgtgatttaaaagattgtctccacttaactggaaataagccaaatgtctatcaatagagaactggttgcatcaactcctgcatctccacacaatgcagtactatgagctgcaaatggaaagcaggatgtttctatattcaactgtggaaggatctccaggatatactgttacattaagaaagaagggtggatgagacggaaaagtttgcctgatgtaatggatctaggcgatgagtatccatggctaccaacacgagacagacaaccagaaatgatcctgagcttcagctattgctccctaactgagaatgagatgcaagagaagtctcactaggaaaggagtcagagctacgggaattttcaagagaactttaaaaattcttcacttaaaactctctttttaaaagaaatcctcgtggagcataccaactactgaaatcagaaagacttttatcattgcaattgtaacaatattaattatgcatagtttattactgtattaagtgtaggtggaatctatttcaagaaaacacaataaagcctaaaccaaaataaaagc

SEQ ID NO: 263053 - DNA, 505 bp, Homo sapiens
agattttcattaatgttatggtgatgaatctttcataaacaatacttaccattgattgtgcttttcttagcctagttctgtcctgcaatttatctttcttatcatgtgactgtcggctgaagtctggggttatttggtttctttttcttcttctgtaaattggaaagcagtgggaaaattacaaagtatctttttaaaactcaggtggtttgcatagctatttgtctgtttgagtttgttgttcctgtgatttaaaagattgtctccacttaactggaaataagccaaatgtctatcaatagagaactggttgcatcaactcctgcatctccacacaatgcagtactatgagctgcaaatggaaagcaggatgtttctatattcaactgtggaaggatctccaggatatactgttacattaagaaagaagggtggatgagacggatatgtactgggtgctgccattcctttcaagaagaaggtattaagatctctgcctctatat

SEQ ID NO: 263054 - DNA, 879 bp, Homo sapiens
agattttcattaatgttatggtgatgaatctttcataaacaatacttaccattgattgtgcttttcttagcctagttctgtcctgcaatttatctttcttatcatgtgactgtcggctgaagtctggggttatttggtttctttttcttcttctgtaaattggaaagcagtgggaaaattacaaagtatctttttaaaactcaggtggtttgcatagctatttgtctgtttgagtttgttgttcctgtgatttaaaagattgtctccacttaactggaaataagccaaatgtctatcaatagagaactggttgcatcaactcctgcatctccacacaatgcagtactatgagctgcaaatggaaagcaggatgtttctatattcaactgtggaaggatctccaggatatactgttacattaagaaagaagggtggatgagacggaaaagtttgcctgatgtaatggatctaggcgatgagtatccatggctaccaacacgagacagacaaccagaaatgatgtgcgttgtgacggaagtacatatccctgttcagtatatacgtaagcctctaggtctgactgtcagtataaccagcctgagcttcagctattgctccctaactgagaatgagatgcaagagaagtctcactaggaaaggagtcagagctacgggaattttcaagagaactttaaaaattcttcacttaaaactctctttttaaaagaaatcctcgtggagcataccaactactgaaatcagaaagacttttatcattgcaattgtaacaatattaattatgcatagtttattactgtattaagtgtaggtggaatctatttcaagaaaacacaataaagcctaaaccaaaataaaagc

SEQ ID NO: 263055 - DNA, 191 bp, Homo sapiens
tccgctccaggacctccaccctagctctgacctctgcccagcccctgatgctccagctattcacacattttgtaccttcacttctttcagttctttgtgcaaatgttcacttagctgtcaggccttgcctcctcaacctacagatttgaacagggcacttcccaacctcctttccctgctttctctgttct

SEQ ID NO: 263056 - DNA, 438 bp, Homo sapiens
tgatggccacagacccccgcccccaccccagcgtctgatacgccgcgcctggggcgatcttggtacctccccgccaccgcgtggggacaacacattcgcagctccgcggttaccaaggcgacccagctggtgtatcctcggtagccccctagcggacacttatggaacctgcagttctttcctttacctcgggcggcgtatttcacctgcagccctgtccagagagggggcggctctcttacctggcctctgtattgcttctctctaccctgagcctggccacccgccccacctctccagacatttcggtttctcctccagggaccaggcttctctggctttgtcacccaggcacaacagctctaattacccatcccttccagccagggtcctggggacttcagaagggctgtcacccacggcacttccaaagtccct

SEQ ID NO: 263057 - DNA, 569 bp, Homo sapiens
actcctcggtcctaccttacacatcgcctagggtgtttgaccctcatttttttctggagtttaggcttctggacaccacacaggccagtctgaaggggaatgctaagcacagtggacagtagaatccacctggtgtgctgcccattcattcggctgcagtatggccctctctgtgtctcccaggaaacactgaacagtggtacatcacccgccctgcgtatctctcccgatatctgggaactattgtactacctctctaatttctcttttctaggctgaatgacccatttcttcagcctcctctcaaaggcaatatttctcagcccttcagtcattttcattgctctcttctggcctctctccaagattctgtatcttgtttaaatagtgaagtccaacaccgaacatgatttaagaacagtcatgcctggaaaagtaacaaaggcccaacgaatacggactccagaaagtaaacattttctcaaaaacaaaagtattgtaatattaataatggtagtaagaattaggttgaccaaataaaatcatttttgttgcccgtcaaaaaaaaa

SEQ ID NO: 263058 - DNA, 526 bp, Homo sapiens
agcacagccactccacgagcttctggaaattccatgtctcccagctgtgcaaggcaaccctagtgttgttgaggaaaagcctaaagaagaccatccatcgtgttgagcgcagggaagtgccgaatgctacgtaggcttgggcattctcaatagttcaaggcccacattacaacttccaagagaagggtggtggatggctcacaaaccagcaatggtcaagggccatttccttctctggtcctggcctagagacttcctggggactcacagaaaaaatgctaccaaatcctgaactctacccagctcttctcccttcctgggggaacaaccatgtggacttccaataagaacacgagcttaaagaacgagttattccttctgacccaagtaaagcacatggcccatttcctgttcaccagagaacttcattagagggaaactgcagacatagcattcaattataaaaacctattcagattttgctagtgtaacgtgcttatttctggatttaacttatatagctgaa

SEQ ID NO: 263059 - DNA, 348 bp, Homo sapiens
cactgggtaagccaacagtgaagaccaagaaggaaaagcacccctccaggaatgattctctagcagcctagagacttcctggggactcacagaaaaaatgctaccaaatcctgaactctacccagctcttctcccttcctgggggaacaaccatgtggacttccaataagaacacgagcttaaagaacgagttattccttctgacccaagtaaagcacatggcccatttcctgttcaccagagaacttcattagagggaaactgcagacatagcattcaattataaaaacctattcagattttgctagtgtaacgtgcttatttctggatttaacttatatagctgaa

SEQ ID NO: 263060 - DNA, 441 bp, Homo sapiens
tgagtggttacagtaaccgagagaggggacttaactttttggtatatgtttataaattagttccatttgtatgttcattctttttttctagtgtcttatctttgggcttattttataacttaagtctgtaaagcagtcactctgaacctgtagtgagttgaagaagcccttaaaacatctcctctgggccgggtgccggttgttacgcctgtaatcccagcactttgggaggctgaggcaggtggatcacgaggtcaggagatcgagaccatcctggctaacatggtgaaaccccgtctctactaaaaatggaaaaaaatagccaggcgtggtggcgggtgcctgtagtcccagttactcaggaggctgaggcaggaaaatggtgtcaacccgggaggcagagcttgcagtgagccaagaaaacgccactgcactccagcc

SEQ ID NO: 263061 - DNA, 456 bp, Homo sapiens
attattctgctaaatataacattgagagaatcttaggttaattttccactgattgcttttttcttgagtataggccaagtttttctgtttctttgtatgtctattaatttattattgttttgaaaacatgaaggggatgtatttcagatattttagtttctgtaattttttcctaaggagagccgataactgtgtgtagtaggcagtttaattattggctaatttcactgatttcctttaaattgtttaatcttaattttatatgttttggtttggttctgtgggaaaccctaaaccatttttgcttggcagaactcaacctccaaactttatctactctgtgcttcttattggtgtttggtttcaagctttgggggtaggtatagagtagcccttgttttcagtcatggtccttactcctaagatgcagcctttttgatgtcttctttggatatc

SEQ ID NO: 263062 - DNA, 440 bp, Homo sapiens
cccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgttatg

SEQ ID NO: 263063 - DNA, 128 bp, Homo sapiens
gactgagaaaccataatcaatctggtagcaatgagcataccaagagcctaaactgtaatagctaaatatttcccattagaagaatccaggctggccgggcacagtggctcacgcctgtaatcccagca

SEQ ID NO: 263064 - DNA, 1055 bp, Homo sapiens
catatatagcatgctttattaagtagttttcattcatttcccaattactgctattagttcataaattgtgaaaatacattaataaactaaaaatatttagtatgcaactaacattatatttgtataactgattcatgcaaatccagatcagccttcttaattataaccattactcagacacctattacctgttatcaccagtatacatagggtcaatgtagcacagacttctggctgaccactaaaactcatttcctcttcttctaggcacacagctagactacatttcccaggacctcatatggtgccaccaagacagagctgactgtatcacccaatgccaagccctcagcgtcactgtcaagtcacattggttacctgagccaataatctcatggaactcaatttctgagagctgaagatggaaatgtgaaggcaatccagctcttaggaggagaatatctgccttctctgcaaagagaaattgtcattttattttttaagggtgattttgtcactgggaatggctgcccacccagtgacattttcctatgtaccttgcatccaactgtggccttgcgacatattttcatgaagggaatatgagcaaaagtgaagtaacttccaggtctgtgccttaagaaacagttccctggtctggatacctatctgtagactcctccaatcaacacatcatatgagactctgacttcagagctgatgacgtaaaatgcagggcctaatctatcttggcaatgtggcagtggtggcagtagctccatccaatttcccatggtagcaattccagccacagattcaatgccctgcattgttggcatcagaagcacaacagtttatgtgtgcctagcaagggtggcagtgcatcttcacaggaccacatttgggcatgattctggatgttgttcctcactgtgagaatttcaaacatggctttctactctgttctgaggaagaagattctgtgtgctacataatatcctttaatctactccttttatgcctaaattagcaagagttagtttctaatacttgaa

SEQ ID NO: 263065 - DNA, 444 bp, Homo sapiens
catatatagcatgctttattaagtagttttcattcatttcccaattactgctattagttcataaattgtgaaaatacattaataaactaaaaatatttagtatgcaactaacattatatttgtataactgattcatgcaaatccagatcagccttcttaattataaccattactcagacacctattacctgttatcaccagtatacatagggtcaatgtagcacagacttctggctgaccactaaaactcatttcctcttcttctaggcacacagctagactacatttcccaggacctcatatggtgccaccaagacagagctgactgtatcacccaatgccaagccctcagcgtcactgtcaagtcacattggtcattatgaattgtgtaaatgcccttggggattagctgaggtgatgaaatgaaatatatatatatatata

SEQ ID NO: 263066 - DNA, 270 bp, Homo sapiens
ccatgacctggaattgtgcatgtgtggaagagaagagcactgggcaataggtagggtggatctctgaccaagtcatgttaagtatgttcaaagtgaaaaattgagctatggtaatgggctggttttgatttaaatgaagcaagttacctgtcgggcatggtggcttactcctgtatagtcccagcactttgggaggctgaggtggggagatcagttgaggctatgaattggagagcagcctgggcaacatggagaaactccatctttaca

SEQ ID NO: 263067 - DNA, 480 bp, Homo sapiens
aactgtcttcattccagccctgcccttctcaacacgacatatagacaaccccaggtcgtgggtccctagaggacaccaccgatactgtgatgtgatgatgaggcgccgttggctgatctataggggtaaatgcgagcagatccacacattcattcatagaatctgaccaccatagcagatttctgcagaactccaccactgccctgtaccaacagcccctccatgtgcagctgccacaacagtactcatgatgtcaatgtcactgactgctttgccagcacagggacccgacctcttcactgccactaccaaaaataaggagtccaccaggcccatgcgagtgggctgcaagaagggggcatctgttcacctggatggctaggttcctcctgacaacggcacctgaatgacttgcaccctacgccttcaaatctgtgcagcactgtcaaggtcttctttgtaaatgcttcgtcctttgca

SEQ ID NO: 263068 - DNA, 483 bp, Homo sapiens
aaacttcagatctcattcatgtagccagtcatttcacttatttctatttttcacctcatattatggaaatgacttgttcctgaagtcgttatattatcactaatttatttgaaagccttaaagttattggcatatagtgttagatattttgtatgatggagtgtgttctgagatcagaaaatgaccctcttcaataaaactaattcagaaatatccatagaacaatctaaattgttatatttatttaaatttgatttttcttcatgtgacttaagtaatccattggctgaaatttggtagtatttagttcagaaaactctgcttataaaatttagtaactttgccatatatcatccatggctattctacagagactaagcttgatcctactgtacatcagtactacttgtgataacaaataacaataacaatcacaatgataatttatcaaaattacctgttgtcagaagtgagcaggaatag

SEQ ID NO: 263069 - DNA, 479 bp, Homo sapiens
caataagaataagctaggttcagtggcacgtgcctataattgcaactattcaggaggctgaggcaggaggatcacttgagcccaggagtgtgaggttacagtgagctttgatattccactgcactccagcctggctgacagagcaagatgcagtctcttttaggaaaaaagaaaaaaccaataagaagaggaataaatctcacagccagatacacaaaagagtacatatgctacatgattccactgaaataagccaaaaaactgacagagctaacctgtgttattcgtagtcaggaaagtacttttcttgtaatcactggaaaggaatgtaaagggaattctagggggattgataatgttcttttttaaaaatctgggtgctcattacaagagtattggtttgtgaaaattcattgagttatatacttatgatacgtacatatctctgtatacacatgttgtacttcaataaaaagttt

SEQ ID NO: 263070 - DNA, 1549 bp, Homo sapiens
  misc_feature (1)..(1): n is a, c, g, or t
  misc_feature (121)..(121): n is a, c, g, or t
  misc_feature (178)..(178): n is a, c, g, or t
  misc_feature (269)..(269): n is a, c, g, or t
  misc_feature (286)..(286): n is a, c, g, or t
  misc_feature (536)..(536): n is a, c, g, or t
  misc_feature (987)..(987): n is a, c, g, or t
  misc_feature (1163)..(1163): n is a, c, g, or t
ngctttctgaagaacttgtgaggatggtaaaggatatgaaaacctactttccatcatggagacatagtaaaccatattctttctatgccttcaaccatgtccttcactgtgtggacagcangcaagcaaacagtgagattttccagttaaaactcactacctctagcacatacaactntgttcaacttgagttgctagacactgttgattcagaacatgcttccaaaaacacagatactcttgtggcaattttttattgccgtctaganggttagtcctgaaattntgtgtgtgtatgtgtgtgtacatacatatatatcttggagtcctctcactttgctgaaatgtgtgcctttaatatatgagagtgttctatacacataatacccagtctcagctttctttctggagcaactatacctgcaaaagtatcttcacagcatgcgtatgcttcagtgaaattctttttttttctttcataacccatggaggtaaagacacagaagaagagaaataatacagtagtcccaccttanctgtggtttggctttctacagtttcaattacctacagtcaactgtggtcagaaaatattaaatagaaaattccagacataattcataagttgtaaatgtatacagtgttctgagtaacctgatgaaatgttgggcagtcccaccttcttctgcccagagtatctgctctataggtgctccctgattgttagtcacttagggttatcacctgtcccagtatttcagtgattttgttcaagaaactcttactgtatttcttaatggacccaaagcacaagagtagtaatgctaacaattagatataccaaagagaagccatagaatgcttcctttaagttgttaataaggaaagaaaatatatatatactaagctggctaagatctacattgtaagaaccaaacttcatctgtgcagttgtgaagaaaaaaaattaatgcatagcatacacanggtttggtactatcctcgatttcaggcatcaaccaggcatcttgaaatgtagtccccatggttaagggcaggctacttattacttaatctacattattctcctttagccctatatacacagctttatcctaacagaatctgaatcttgctgtctcacactggttaagaagattcantctggctatggagctcctcaaatactagtggataaagtaatttttaccaccacacacactccaaagtgtgtttttctttaatagagtggcagtttagatagtggtgtctttgctgggtgactgtcctcaagatctggttggaatatcattcttaatgtatttgcatacaggatataattccttgttgatacataccaaaaaggcttgatgtttgtaggccaccttctctttgaacattcattcactacattttgtattcaaatggagactacaaagggagagattttactggggcaccaagaaactctgaggaagataaatatgttctttatcgtgattattgtaatgtttcctagatgcatacgtaacaatttatcaaatgttgc

SEQ ID NO: 263071 - DNA, 188 bp, Homo sapiens
ccctgatcggcagtcacaaagtcacagcaagacttcgcagagctcagcacctaacttctgattttcctgtagagaaaaggacagcaacaaggtgggtcgggctggaaaatatccctacaggagggcaccccaggaccagtgtttctgccactttgctgtccctgcaccctctgtcccagaaaggtcta

SEQ ID NO: 263072 - DNA, 333 bp, Homo sapiens
agggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaatag

SEQ ID NO: 263073 - DNA, 414 bp, Homo sapiens
aagagatattggcctgtagttttctttttgctgttgttatgtccttgtctggttttggtatcaaagttattctggtcttgaagaatgagttaggaagaattccctctgctttaattttttggaatagtttaagaggaagcagtattaattattctttaaaaattctataggattcagcagtgaagccatccagtactggacttttctttgttgaaggactttttattactgattcaatcttgttacttgtcttggtctgttcaggttttctatttcttcttggtttaatcttggtaagttgtacatgtccagaaatttatcagtctctacagttgttcatagcagtctctaatgatccttgatagttctgtgatatccattgtgatttcttctttttcgttgctgctgttattt

SEQ ID NO: 263074 - DNA, 541 bp, Homo sapiens
tggatgtggcagcttctgcagacggggttctggctgtggctatggaggctacggatatggctctggctttggaagctacggatatggctctggctttggaggctacggatatggctctggctttggaggctatggatatggcttgccgcccatcgtacaatggaggatacggattctctggcttttattaaatgaattgctgaaattggaagcagaggagaaacctccaaatgtgtttggtcctgtcccgtgctttcattccaaaaatccattctattgccttcagcatcaatggagagatatttagctatgttaaatctttaaaatagatttaagctgcttctgtgaatatttgttgtctttttactttcggagtccgtcacctgaaatcatattcatgtataactactctaggttgttcttctaaatttgctttatttttcttaccaccattaccttgatgttatctatcaagatcctagcaaaaacttgtattttgcttttatctaataaatgaagtaaagtataaatattttagttc

SEQ ID NO: 263075 - DNA, 463 bp, Homo sapiens
aatattctcagtaagttttttgggtttttttgttggtttgttttttgtttttgttttgtttttgagacagagtctcactctgctgcccaggctggagtgccgtggtgtgatctcatcttgctcggctcactgcaacctccccctcacaggtgcaagtgattctcctgcttcaccctcccaagtagctgggactatgggcagattccaccatctctactaaaaatacaaaaaattagccgggcatggtggcccgtgtctgcagtcccagctactcgggaggctgaggcaggagaatggcgtgaacccaagaggcggagcttgcagtgagctgagatcgcaccactacactccagactgggcgacagagcgagactccatctcaaaaacaataataataataataataatgtaaaacttaagaaagcatgtgacatttaagaataaagaattaaagtagtatttc

SEQ ID NO: 263076 - DNA, 157 bp, Homo sapiens
tgcaagttcttagcatccagtattaaaagaaaagagatggctctgttctcttagcaactcaaaatcctcttccttctccccctttaaaatataatgtagtccttgtttttccttaaaataaatattttaaagagaaaattggtccatttgaagaagc

SEQ ID NO: 263077 - DNA, 879 bp, Homo sapiens
ctaaatatttcagcaacttcagaggcacttaattttcctccttttgtaaactggcaatcttgactctaacattgctaggaattacttatctatatttgtccttaaatacaagactattaaaaaaaaatcaagggctgctttctgcccgtggataccgctgaggaagcctcgttaaagtctctcttcccagggccgtcctgtcctaaagagccggaacagctgcggaagctcttcatgggagggctgagctttgaaacaaccgatgagagcctgaggagcccttctgagcagtggagaaggctcacagattgtgtggactccaagtgaaggtgaaagagaccagacgagacctttcctaattccattcatctctgagggatttataaggaagttaccaacccctggtctaaataatcaaacagagaaaagaagaaaaggaaaaaaggatcagaggacacagaagaatttctggacacacttccatctgctaattaaatggaaggagcaagtttgggtttttttgtttttcctctacctcaatcaaagactatgaatctttcttttaatctctggagctaacttctctaattagtttcctagaggaagaggatgctttactattggcatttcacactctgcacaatggtatgaacttgacatacctcagctgatccagcagaaagagctctaaaactcaaaagttatgtcatcagtaactgtcaatagatagaagtgttcgcaggtactactagttccaatactcattgactttgtaacaactggtatattagctacaatcaaacaaaatgaggtattctttacaagaattacataagccctttccaataaattttctgtaacgatggaaatattctataa

SEQ ID NO: 263078 - DNA, 566 bp, Homo sapiens
cctcaatgctctgtgttgtgttttttctgagacatcaataacagttcttattgatccgttgacatttgggattaaaaagtcatatgcccacttagaataaaaactggttaatgtcctcaagataataaaaatcaaaatagtggtgtcttttgtagaaggacagaaaatcatgtcactgcatcttaacagttttaaaaaattataaaataactagacactaatgaattgtaccaaattaagactctctaggcctagagagtcagatgactcccagacaggcctcagaaaatgctctcaactaggccaagtgccgtagctcatgcctgtaaggccaaggggtaagaagatcacttgagcccaggaatttgagaccagccttgtcaacatagtgagagcccatctctacaaaaaaatttaaaaattagccaggcatggtgctatgtgcctataatcacagctgctcaggaggctgaggcaagaggattgtgcaggaggctgaggctacagtgagccatgatcacgccactgcactccaacctgaacaacagagtaagaccctgtctcaa

SEQ ID NO: 263079 - DNA, 374 bp, Homo sapiens
tgcctcccaggttcaagcgattctcccaccgcagcctcccgagtagctgggattacaggcacccgccgccatgcctggctaatttttgtatttttagtagagacagggtttcaccatgttggccaggctggtcttggactactgacctcaggtgatttatccgtctcagtctcccaaagtgctgggattacaggcgtgagccaccgtgcccggccttaacttttttttataataattcttttatagtttttactctcatatattatactgcatgtaagcccattttctgttagtttgcttttgaaattctttggagggtactcttcagggcttcacaataaagaccttaataatattttcctccttaattaatt

SEQ ID NO: 263080 - DNA, 301 bp, Homo sapiens
cttgtatatattgatgcttatggtactgttaagaaccctgagtttgcagtcatgttattttcatttttaacaatttaatttagaattcaaaaactttttatatgtttttcctgataaatagtgcttaaattacttgtcaatattctgttccaaagaatgcatacaaattggattttgtttttcatttgatgtgtgttaagagtggaaaagatgcataactgacgtgcatctggcatatctgatgtgccgcaactgccaacagttcagataactttatggtggtcacaggtcagtcataatg

SEQ ID NO: 263081 - DNA, 390 bp, Homo sapiens
gagactcattgattgattattgatggatgtatttgtggtctggctctggggcctcttggccaggccctgggcaaggacaagaatggggatgaggtgggggtcttccaaccccaggaaaggccctcaggctgcctcccccaacccccagcatccctgcttctggcctccacccctgccaacttacctccgcccctggatttaaagtcacagtgacgattaatcacccaatgacatggagggcaggctgcagaggagttaattaattagggaaatttctcctggccctttgaaggtgaaatgtgtggggaggggacaaggccagggacagatattattcaagctgaacaagctgactctgggaggcttcgagaacaactccaggggagcttt

SEQ ID NO: 263082 - DNA, 292 bp, Homo sapiens
acaagaatgaactccttaggagacgtctcttgttgtgttgtgggctctgtgaaggatgaagttccacacacctcaggtgaaatgtttgaaggagccattttttgttctagatgtgcacctggaacgtggcttctagatacaggtcttcaacacagcagataagatgtctggaaagatctctgggctcaagtgcaggtgaggttttagcacagttatcagaggaactgatccagaagcaggcttagttctagattgagttctagagtgctaggctgataaaatgtcccaggga

SEQ ID NO: 263083 - DNA, 405 bp, Homo sapiens
tttacaatatctttcaagtaaacagttttagtgggttttgaacccacttgttaaaaatatcaaaagggagcaccttccaattagtttgcaagaacaacatcaagattaggaaacatggaaatttactagccagatgtcaacaaaaatctgtgcataattggcagttgggattgaaaaatgaatatcattagctgcttctgcaccaagcctcaagcatttgtgtggaatattttccagttatgatagactttcaaagcatgtattcaactctatggaacctggctaggcacagtggctcacgcctgtaatcccagcactttgggagggcaaggatgacagatcacttgagatcaggagttcgagaccagcctggccatcatggcaaaacctcatctctactaaaaa

SEQ ID NO: 263084 - DNA, 761 bp, Homo sapiens
aaggtattccaagctagactaacaggtttagtatgaaagaaatgtaagcttcatatgatttttatttttatttttatttttgagacggagtctcactctcttgcccaggctggagtgcagtgatgcggtctcggctcactgcaacagccaccttccaggttcaagtgattctcatgcctcagcctgcagaatagctgggactacaggtgggcaccaccatgcccggctactttttttacatttttaatagagacgggggtttcaccatgttggccaggctggtctcgaactcctgatctcaagtgatccacctacctcagcctcccaaagtgctgggattacaggcgtgagcgactgcacgcagcccatatgattaacttttgtccatggattcttacctacctcttttgggaactgggtcagtttaggtttctaaggtaggagagccatctagtaggagcaggttaaactagatttctgaggtcatctacttatggtcataacatttagtgttgtgtgttattaaaaagtcataggatgccatctgatctgtataccatctaacctgtaccctgtatttcttttatgcagagaaggtaggaaatacaggtaaatgttacctgagtggttgggtttatgagtgaagctgtttttgcatatgttttggtgttttccatttgttactgctgtagtcagcaaaagtgattttaaacactagaactgtcttgaataaaaccatgattatgtatcccttttccagg

SEQ ID NO: 263085 - DNA, 215 bp, Homo sapiens
ccccatgctactaactttctaacattcatgtgaacaagaatggatcaattctctattactttccattaaaccagcctcctttgtgtctaaccctaaagtctagatacagactggactctatgtttcgaagttccttctgctgccctgattggagcttcacgataactgctagagtttaggtagagcatagattgtcttccttgtaaggaaataaa

SEQ ID NO: 263086 - DNA, 405 bp, Homo sapiens
gccaccttgtagctgtgagtaattttcccattttgttgaaggtaagtacaatttttaattggctacatttggttgcaggagaggttaaagaatagatttaagtaggcatgtctgaaaaggacagaaagttccacaaagcagttgtcagcagggattagatctctggatgtccttgtttgtcaggaaaagccttctgtgtatccagtagcttctgaaaatgttaatgtggcactgtgcagggagtcaagggaacagtctcctcattttcagtgcaggatgctagggaaagcctgtccgtatgtgtgcgtgggtgtgtgagtgagggctggctgtgcaccctgcctctctggctgaagtaagttgcagagcagctttgccttttcatgggcttgggtgtggggaatc

SEQ ID NO: 263087 - DNA, 399 bp, Homo sapiens
tatatctttaggctcctgggctgacataccatagggtaatttccaaggcataagagttctgggttagaactttactagcaagatccatgtcttcctccaggaaggtggtactaatttacactcataagagtgtctgttttaaatgtttgccaggccagtaagtgaaaaacagcatcatcttataattgacttttaatctttaacacagtgcaaaatatccttttatgattatcgttgtttgctttttatttcttctgtaaattgttcacatcctttgcctgttgttagtgatttctcttatggtttctggatttaaccctttatataattatcttaagttttctcctggtgctttaatggttctgctttttaaaatattattcttatttaaaaaaaatt

SEQ ID NO: 263088 - DNA, 393 bp, Homo sapiens
gagtagcattcagttaggaagtgttggagagaaaatctgaatccgcatttacccgactccaaagtccttactcctgtcatgaggccatctcatctttttggtatggaatgtaccagaggaaggaaaagcattcaggtatgttgcccaggcaggtctcaaactcctgggctcaagtgatcctcccgccttggcctcccaaagtgctgggattccaggtgtgtgctaccatgtctgaccctcagccagtttaatcagattcctctgaaggagcgttgcttggaacataatcaacttaaacaggaaaagaagacagaatgaggagctaccttgcagcatccccatggctaggaactgcagacagccacgaggagctgacagccattcctgccaacc

SEQ ID NO: 263089 - DNA, 622 bp, Homo sapiens
  misc_feature (578)..(578): n is a, c, g, or t
  misc_feature (614)..(614): n is a, c, g, or t
aaggaaccaaccctgctgacatcttgatcttggacttccagcctccagagctgtgagagaaaacatttccattgttgccatccagtctctgtttgctgttacagcagcctcagtaaataaatacactgagtaacagaacaaatgtatttatgtgtacgaatgcatttgttctattactcaggtctggaaagtaattttaactggcttgccaatcccagatgaattccagttgaagtggcaagccagttaaaattaccagccctgagtaacagaacaaatatccccatcctgggagctttatttctgataatagtcaagtataccttttatcagacaccctcttgcaggtaacagtggtcagctctggaccaactatatggagacatatacctaatatctgtggccttgctcaacttttcaatgtcagcaatggttttcccatacctttgccaacagttgttggttttttaaacagctttgttaaggtataattactgctatggtttgaacgtttgtctcctctgaagctcatgttgaaatttaatccccattgtggcattaatcatggatgggataantcatccataagcttatgggttaattgagtaatgggntatctggt

SEQ ID NO: 263090 - DNA, 449 bp, Homo sapiens
accatttaggtttgtgtaaggacactctatgaagtttgcaaaatgtattcctgagaatgtgtcgctgtggctaagcaatgcatgattgtatctgcatgtgcacatctttaccaagaatatcttactaaagattctgaggcagtgagttttttacttcttcatagataatataaaatagacaaatctaaaggactttatttattatgaatgaatagttcttgaggctggggaggtaagaaccctgtttaaaaaaaggtttataacctgattaaggaaatcatgaatgttgcaaaagaaacacatgactttgttacatttgtttggtaattatgcagttatttattcatctgtgcaagagatcattagagtctggattattttcaaaattttagtttctaaatatgacatgcattttcaaataaacatgaatatatattaagaatacagaa

SEQ ID NO: 263091 - DNA, 698 bp, Homo sapiens
aaagaaggcattgtatggtactgtgaataatatacaaaacaaccctttacattaaagaaaataatgcacttatatttgttgtgatattcaccattgcttttgaaatgcaaatgtcaaatatgcataatgacataacgtagtgctggagtagctgtggggccttggttgaatcacccaatttctccaatcttcagtttctttttcaattcacccagtgtcttcttcaactatgaaatagcatgacagtaataatcacttgcaaatctacctcccaggaagaacgtgttggaccttcacaaactatgaccagccttcaaatgcaaaacattattgtcatagtgagtgtggttttgtcagagtgagataatattgtcaaaataacaaaatccaactcaaacgtgcactgcttttgcattcttaaattgctccaaagtatttatccataatttttagatacagaatggtctagaagacattaaaattctcagaacaacctgttgaatgttgtcttacttctcgttgttcatcaagcacatcaccttatggattgcctggagcatatatctaattttctatttagaaacaaatgttgttttcaccaattactccactgggggtcattccccaactcatgacctttcttcttgtggatgagatcattgagaagtggctgtccagccaagaaaactgacactcca

SEQ ID NO: 263092 - DNA, 422 bp, Homo sapiens
gttagttgtgtatcctgatagaaaatataaacttaaaaagatttctttgtgagacagaggtctcactatgttgctcaggctggtctcgaactcctggcctcaagctaacctctcgcctcagccactgtgtctagctaatataaacatttgtttattcattccacaaatattgattgaccatgaaggatgtaccaggcacaattctaggctcttgggataaggtagtaaatgaggctgccccttgatgaggggtccctgctctcactgagcttacattccagcagggaggctgatgatgagaaaggaaaccacgtgtttcccaagacctgtacattccgccagggcagggaacatgttgcatttgtaccttgatctatcccaaatgcatgagacagggcctaggtcaggcacttgatgaacgt

SEQ ID NO: 263093 - DNA, 396 bp, Homo sapiens
tcctaccctcccatcctctctcccttccttctccactgaggcaagatagaaactaaaattcctcttccccaaggaaccccgcctttttgtgtaacagttggccataaagaaattaagaccttcattccagagagtcctattgcatgcctgagagggaggaaggctgcacagagacgccaagaagctggacagtccttgctgggtttccccactcagtctttaagcattcgatcataccccttctgtccagttgtattttacatggctgtccatacatcattgaatgtcagtgtaaaaatggattgttttccctgtatctttgggtctttattctgaagtctcttttaaaactatgatcaaataaatttgtatgccttttctcctattaatctgtcc

SEQ ID NO: 263094 - DNA, 389 bp, Homo sapiens
attctatttatttggcattctgggataaatgaggggatttgggaaatagagctcagtgaaaaattcagtacacctctattgataatttgagacgatttagtagagcatcaggaaaggtgtatgtgatgtggtcacctcaggttgctctctgccaatgggtactaagtgtaaagtatacaaaataacagtatattcaagcctcagggagtcacacaaatagtgtttcaatgtaatctcaaccagtgtaatgttgaagagttatgacaattgctttaaatattgtatcattataaaaaatttacaaccaactgcattttatggtacaccttcaacctatttgttattgggaagctatgggttaaattacaaggcaaattcaggactatgtg

SEQ ID NO: 263095 - DNA, 406 bp, Homo sapiens
ggtaaaggagtattatgaagggacagggaccatacacattcatgtagtatagcgactcattgctggcattcatcatgatgggacaggcattgacaagctatggcctgtgggccagatctgacagcttgcccgtatgtctcgtgggctaagaatggttttcacattcctgaatggttggaaataaatcaaaagaagatcagtattttgtgacccatgaaatttagatgaaattcaaatttcagtgtctataaacaaagttttattggaacatagccatgctcatttggttacatattgtctacagctgctttcccgctgcagtggcagagttgagtagctgcaatggagactgtgggcccacagagcctgaaatatttactatgtggacctttacagaaaaagtttg

SEQ ID NO: 263096 - DNA, 1045 bp, Homo sapiens
ttcagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaa

SEQ ID NO: 263097 - DNA, 504 bp, Homo sapiens
ttcagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattg

SEQ ID NO: 263098 - DNA, 761 bp, Homo sapiens
ttctaaaaataagcaaacaacaaaacagagggtcaagatctgtttctctctttgattcctaagatttgtttaaagaaaactttgtttcagaaattacatatttcagacacagttttaggtctattttgttctattccacataatatcgatactaagacaatgattgggccagcagcattttactaaagttttcccaacgacattaaccaatcaattaaataattaattttttttgagacagagtcttgctctgtcacccaggctggagtacagtggcacaatctcagctcaccgcaatctccacctcctaggttcaagtgattcttatgcctcagcatcctgagtagttaggactacaggcatgtgccaccatgcctggctaatttttgcatttttagtagagatggggtttcaccatgttggccaggctggtctcaaactcctggcctcaaacaatcctcctgccttggccttccaaagtgctgggattacaaatgtgagccaccacattcagctcagacattaatttagcttgatatatatatatggattaattaaaggaggattagtcagaatagaaagcactgaaaaaggaaaattacagaagaaaatctgagtggtgctcattcagttgccatccagaggaaaaggaatcttagttgtcaggcctgaactactcagatcacattgagcatcttatgtctgttttgagaacagtatatcaggatgacttagcttgtagtcattaaacttgaaattta

SEQ ID NO: 263099 - DNA, 695 bp, Homo sapiens
acaacaccaaaggggaaatccagccctgtgatccagttacctcccaccaggcccccctccaacactgggggttacaatttgacatgagatttagcagagacacagactcaaaccatgtaatcattttacatatataaacattgatatgtacatttgtcatttttgatgacaatttccctttcctattttgagaaaattctcctttaagtgttatgttgaccattgggagttccttctttttcattttagaagtcaaacagactgatcctttctctataaacttttataaagttcatatacacttgatatgggcttgattttcaggacatttctctctgggactgaattttcagcaactgatgaaaaatcaaagtgatggtcaaaatctgtggactcagcagcagtgacagtggaagcattcttctggataagtaattattgctttcagccttctagaactgccttagtttctgtccacttttcagaatgtctctttttactttatgtaaccacagttgctttctattgaatagaaataagaatcccattggatgaaaagcttctcatactctggtcctatccttcttagcatcttcatcactttgcctgccattcttgcttaaatactctatgcaacagccacacttaatttcttactattatacaaatagtaagctcacagtttacaataatat

SEQ ID NO: 263100 - DNA, 476 bp, Homo sapiens
cagagcgagaatccgtctcaaaaaaaaaaaagaaacgaggcatcacattggaaaggtacagggaagattctaattttaaacagaatttctctgactctagtgctttcaaccgtaatattaccataatcatcatcatcatcattaagaccctttattttcagagctgcacagataagaggtctgtaataaaagccaggctcagtggttcatgcctgtaatcccagcactttgggagtctgaggcagatggatcacttgaggtcaagagtttgagaccagcctgggcaacacggtgaagcccatctctactaaaaatacaaaaattagccgagcatggtggcaggcgcctgtagtcctagctattcaggaggcagaggcaggagaatcacttgaacccgggaggcggaggttgcagtgagctgagatggcgccactgcactctagcctgggcaacagagaaagactccaactcaaaaa

SEQ ID NO: 263101 - DNA, 146 bp, Homo sapiens
tacaacccactaaatgtgcatgtatcatctgtccctcctagtgtctccttatagaaatggggacctgggaacaggtgcaaaatatatgctgatacactggctactggaattagcttaaagtaataaactcccctttttctgtgact

SEQ ID NO: 263102 - DNA, 281 bp, Homo sapiens
ggggaaaaagcagttactgaatcaaaaatgccttgaggacgggagccagctttctcttctgccgccttccttagcacttaggacccaattctgcacagaacaggaggacataaataattctgtctttgttggctgtctgtttactttaccttctaggctatcagcaatagtattaaccattgctacatatttaaccggcaagtactggtatcttgagtttggtcactgtttttcattcaacccagggtacagttttaaaagttttctatacctgtagtttc

SEQ ID NO: 263103 - DNA, 1544 bp, Homo sapiens
tcagggcactctatcatcaccaactacttgttgaactatgtcctgggtcttgaccttgaaggatgcacgcgttcgggttgaaagcctccatgcagggtggaaccgatcgcatccgagccctgagctagcaggggcgggtgtccacgcgagggcccccgccgtgggatgtcgccagaggagtggccacttacacgtccgcctcatgcagaggctcctggagcgcccctgccagcagcggttggggaaaaagtaccagcttgagctgcctccgctccacgagagggcgcggaagcccaagggctcgaagaactgcctgcagagggtcagggactgcgagctgtccgtgctgacgcggcgttccgtgcgtggcccggaggaccggggcgccctggaccacatggtcaggatgatcaccagcctctaacagccccgccgtggccctcgcgtgccagaccgtgtgcccccagagctccctgtgcgtggggaagaggcggctggcggagcaggaaatcctggcggctgaggaaattctggcgacgcggcggggggtggggaggcaggcgcaggaggcggacgaagcggagggcgcagagcagcacaagcggccctgcccagaagccgcgggctcccggcagggctccccaagagccggcctcccacctgccccgctgccggggtcctggggctctgtcgaccccgccccgcggaaggccagcctcctgcccctgcagcgcctgctgcggagcagcttgcggcctgacgtggtggtgccccggatccgcctcagcaaggcgcccgcgcccaccttccagacccagaggccggcgcggaagggcagcaccaaggacagtggccacctgcgaatacccaactagccttacaaggtggccacggaggagaaaccggaggctgaggaggccgagaagaagcgccaggccaaggtgcaggagaagcgcccgccgccctggaagaagaggacgtgagaatccgcgggtgcttgacacggggttcgagggcagggtgaggccgcggggctgagcaccatggccgctcccgggaccaccaggccgcgcgcgtttccacgctgtctttctagaatgctcccaggaaggagctgggggagccacatcgattcgcctgacaccagccaccctagcaatcagtacacctagcgggcatgttgcctaaaaggctccctttagagaacctcaattaagatgtttttaaagatcaatttattaggccgggcgcggtggctcacgcctgtaatcccagcactttggaaggccgaggcgggcggatcacctgaggttgggagtctgagagtagcctgaccaacatggagaaaccctgtctctactaaaaatacaaaattagccgagcatggtggcacatgcctgtaatcccagctactcgggaggctgaggcaggagaatcgctggaacccaggaggcagaggtggcagggagccaagattgcgccattgcactccggcctgggcaacaagagccaaactccgtctcaataaaaaaaacctcaattta

SEQ ID NO: 263104 - DNA, 698 bp, Homo sapiens
  misc_feature (44)..(44): n is a, c, g, or t
aattcgcggccgcgtcgactacggctgcgagaagacaacagaantgggcatttctctaatctctgcagtgctccctcctcataagatagtcatttcctgagaatttaataagaatataagattaatgacccaaagcactcttggagccggcgattaattcccccaggaaataccagtggtctttaaacaaaattgcctaaattatgggctagtgatgcatgtccgctcagggcttgggggtggggggattgtcaccccaactggttccgatagatggcgcctatcttcatgtaaatcattcaaatgatttgttttccatttttttcccagcaaaaaccggggaccatttaaacagacacacacagcagggagtggagaggacttagtaaaagcccagacaggaactttccgtccaaggttgtttccaggcctggcacgcctctcaggctcagactgagccactccagggtgcagccagggacttgagcagcagtcttgcttcctatgcacagcccgagatgggcactagcagcaagagggacgcagggtgggagtccagctgaagagcacagtaaaaaagcccctttcggccgggctcacgcctgtaatcccagcactttgggaagccgaggcaggcggattacgaggtcaggagatcgagaccatcctggctaacatggtgaaaccccgtctctact

SEQ ID NO: 263105 - DNA, 429 bp, Homo sapiens
cctagctctagatgacttcgaagagggactcagctgaatccacagaagtccctgtgcactggagtcctgatccactaggtaagaagcataaccatcctgaagtcattttatctctgacacatcagcattgaccataataaatactctagccagtttggtggagcccaatccactggactacaaacattaaatgatgttatttttgtccctaccatgatccagtcaggaagctgaatgccatgtggagaccatgtacaggaccaggggagtgccaatagcagcccatgagcccggcccgaagcccctccagatgatcccaaccaccagttattcaaggcaacagaaatcgtagagcagggataaactataaccccatgtctaaatgcccgagccacaggacctgtgagcataatcaaatggtcactgttt

SEQ ID NO: 263106 - DNA, 659 bp, Homo sapiens
ttgagcttctcctttttttttttttttttaacagactctatgtgctgccaacgagccggtctatggagcacagtttgaatagtgaggatgtctgatggtcaggaaggagatgtgtagtgtggagatcagatctccagaccataagaggagaagatacaccttatgttttccagtcatgagtcatcttgaccctccacccctgcacaaaatctgtccttgtgtatgtcggcatggagcccagcattttctgggagatataaaacatccatcaaattaggtggcctgttgttttgtttggcttcactttaacttccccattataagttgttctgtctggagaaggcaggtgaaccatttcccaccacagtggaactgacgctgcatcccaatgtccttctttaccttctagaaaacgctgcagccttaggttgctataagcagataatttctctatttctttctttaactcttttccaaatacatgcaataaaacatctggaactttgctattgactatgttgagcagctacttcgatcttactcaagattagttccctatagtttaaaacacacacactagcaccaagttcacatctatttcagtactttgaacttagtagatgaccaataactgttttccaattgattggttatctaat

SEQ ID NO: 263107 - DNA, 356 bp, Homo sapiens
gccacagcagacatgcctccgcgtaaattcctgacagggaacacctacggcctacaggagatgaggagagaagagaaggcacaaagaggtagcgtgaggtggtttccttttgccatcaccgtgcttcagagagactcactcaagcagtttaaaagcctcagaggaactttcatcaagcgcttctagacgtatttaggtgccactctgggcactccccacagaagttccagaagaactctgactttcaagtcagggatcaaggcttgttctctgtggcagcgccactctcaccagcctccagtggtggcagcgctgcaggatgactcttcccccattgatctgtccgtcctgtgacg

SEQ ID NO: 263108 - DNA, 268 bp, Homo sapiens
ctcttatattgctgttagttaaaaataaagtcgggttgcaacccactataaatcttattctacatgttacgaattcaagacacagagggctgctatccagtgtgctagccatagacaccaaatgtcttggttcccaatcttttgcattagagatatgtgcgacatatttaggggttaaatggtatgatgtctggaatttgcttgagaatagtggggagcgggaggtgaaaaataaagcaagttggccgttaagtaaggccatagaagc

SEQ ID NO: 263109 - DNA, 342 bp, Homo sapiens
aacaggaaagtcatgatctaatttatatcttaagatataaacacataaaatacgttttaaaatccataagtttctaataataataacaagctatttgatcacaattagaggatgctagtgaacaattcatttttctgaaagctagtaaagggcaagaataaaccatgtgtcctgcctttccaacatgaactgtactattgggtaaccaaagagtggaggaggagaaattctccttacagaattattccagctaatgtatgaagaaggaatgatagaattagtatatttgcattttataatcttttgttaattttccatgtagttttcctaatatcagagaaa

SEQ ID NO: 263110 - DNA, 423 bp, Homo sapiens
aatctaggctcttaaaggcaaagaaaagatctagatgatatggatgagtagggagtgctgatttgaaaagttgagggtgaatagaatggttcccagctttctacagcatgtggaatttccttcccttggggggaatagagaggtacaggttctgcccaccgtgggggcctgtgtttgactctctcccagaccccagagtggcagaatgtttgatgggttagctgagtggacacttggctggggactgagctctaagccatagtctccagggctatgagcagtgggaccactgaagtctggacatcaagcccttcacagtgaccacactgtcttgaagtctagaactcttccctcagattccaagattgggtgaactcagggggttctatgtgactccatcaaggggcagggaaagagcaggca

SEQ ID NO: 263111 - DNA, 500 bp, Homo sapiens
aaaaaagaaagaaagaaagtgggtttggtctccctgcaaaacaggaaggcagagggcagccctgggtggctgctgtgagggagtctagtctggctcaggccttactttcgtcatctgtaaagtgagaaaaaaagtcccaccagcggaaccttgccatcctcagaggaggactggtgctagctggttttacagatgagctgaggccactcagctgaagccggacaactgtggagcggctgggccagtgtgcaataccaggtctgagagctgagcccgaggacctgagccctgcacccctgggctggagagagcccacaagcatcaccccttccaggcatcactacttcatctggggacgggaagactcagaggactgggccagggcctcgggctgtcagctgggatgcagccctggggttctagctgccagctccagggatcagggccctatgctaatgctctgctgttgccaactttaaattcttagggttttttgtttg

SEQ ID NO: 263112 - DNA, 454 bp, Homo sapiens
tcaagcaattctcctgcctcagcctcccgagtagctaggattacaggcacgcgccaccacacccagctaattttgtatttttagtagagatgaggtttctccaagttggtcaagctggtcttgaactcctgacctcaggtgatccgcccaacacaccctcccaaagtgttgggattataggcatgagccactgcacctagccttagatgcttctttagttggtggttgtgttacaaaatgcctctttttaaaaggatggctcatttttataaacaaggtaaaaatgtgatttctacttttcagtttcaaaagtgcaggaagtttctttgcttttgaaatctgcagctgatcatcacagacacgcctctctttgcaagcgaatactattttgctgaaatattagcaaggggagagcttactagttttactgaagttgccaataactggattgtat

SEQ ID NO: 263113 - DNA, 432 bp, Homo sapiens
caccatgccaggatggaaatgaattattttgtaatgtaaaaaataaaggaaagaggacagctctaactaaagtcaggactattgctatgttggacatgcctcagccaggactcagcacagcaagtgggttttttctgttcttaaaaatatacttaagttgggccaggcgcggtggctcacacctgtaatcccagcactttgggaggccaaggcaggtggatcatgaagtcaggagatccagaccatcctgagtaacacggtgaaactaaaatacaaaaaattagccgggcatggtggcacacacctgtagtccctgctactgaggaggctgagacaggagaattgcatgaacccaggaggcagaggttgcagtgagctgagctcgtgccactgcactccagcctgggcaacaaagcgagactccgtctccaa

SEQ ID NO: 263114 - DNA, 358 bp, Homo sapiens
catggatctctgtgtacatgctgtgagatacaatctgaggtttgggtgaaaactggcatcttgtcaaataaactgcttgaataactattgctataaaacatataaatttaattactgcaattattttgtgattgtaaatcaaggtatccagaaactggaaagtctatgaagcagccaggctagcccctctgccagggaaagatgcagtgagcgagcctgggctgcatgaggcacacaagcgcgatgccaggcaaacacccgtcgggagggcccagccctgccttctcgttaggatacgtgagagcttatgaaattttaaaatcttgtttaagaaataaaaaataaaggtatctcacca

SEQ ID NO: 263115 - DNA, 576 bp, Homo sapiens
acggaaaatacatgcatctgggaaaatttcacaagatattttatcgaatgttagtatactctacacgctgtcctgcaccttgctttttttactctatgcgtcttgcagatcattttatataatacatagagaggtgactcattctttttaaaggttacattaagtttgtagtatgtcagaatggcaatactataattgttttaaccagtgacgtttaagttgtttccagattttttgatctaacaaataatgtgtcatgagtatagaatttttatgttcatgtactagtatagttataggatgactcatatttgaagcaaagtacaaaacgcatgctttctgtagctactcataaattctggtatgagcaaaatgtcaagatgcttgcttatcaccgaccaagtgatgattaagctcttgctaaactgtatcaaaggagaaaaagggaaatacaggcttatcctaacaatttcacagtgaacagtaatctctggcattcagttaaagctagacttgttctaattactttgattttgaaattattattaaataaaatcacaagccttttctcaccac

SEQ ID NO: 263116 - DNA, 666 bp, Homo sapiens
attttcctcctcttacaaggatatcagtcatactggtttagggtcgactctgattaacttacagatttgggaaggggattaggacttcaacttttttgggaggggctggcacaattcagtccataaagagcttgttctttaccagctgtgccacttggatctaccctgcagagcaggacctgtgtgtatacttgtttgtgaagacgatagaaactgatgttgccatccaactcccggcatctagtagggagagtcagagtggcaaaacaggcattgcctgcgtgccgctactacctacttggtacaggtcttctgtagcatggagctttgggaagcagtatctgctgatgttcaccagctgctaaatctcctaggaatagctcttctactcctgggacctacaggagatgagagctgctactcaactgaccccactagaatagctcttccataacacagagttgtgggggaatgggggtagtctcttatctcgaatgccatggcttcccactattatgactgaatttcgatagattttgttgaatgaatgttttacaatttgttgtaagccctctgatcaatctccagagactgaatcattgtctttgctaatttttgctggtttaataagtgttggagagaagagatttatccaagctctttata

SEQ ID NO: 263117 - DNA, 683 bp, Homo sapiens
gagggctgtgcttcaccatggtgtctgaacaggatgggtgggctggctcaggctgttgattcaggtgagtggatgctccaaatgcctggatatctgccagagggtggagcagagagggcctgggcttcaccacagtctccacacaggaatggttgggtggcttggtatgctgatctgggtgaatggtagctgcaactgctaggagatctgcctgggcatgaagcagagagggccctgctgtaccatgatctctgcacaggcagggtggggtatcttaggttgctagtcaatgtcaccaggtgtttcaaatacctggatttctgcctgggagtggagtggagagggacccactgcaccgtgatcccagagaaggaggttgggccacccagaaatgatacacataaacctgttctatgtctccaagctggtcctggctgcaagtctcctcatccaggagaaactggatgagcagctttcctccagctccaggcctgtgacaggggagagcacaattccagtgcctactgatgaggcactttctgtaattctggctgtagagacctctacaccactccagagcaagcgctccaatctctggcccaagacaaaaatgcctgtgcagccacggtgccagattgccaaagaatggctgactttgtatgcactcgggttaaaaacggcat

SEQ ID NO: 263118 - DNA, 449 bp, Homo sapiens
aggagtttttgattttgccctttgccttgtgatctttattggcctcagaagcacgtaatctttgttctcccttttgccctttgaagcatgtgatctttgtgacctactccctgttcgtacaccccctccccttttgaagtccttaataaaaacctgctggttgtgcggctcaggtgggcatcacggtcctaccactatgtgatgtcacccctggcagcccagctctaaacttcctctttgtactctatttctcagactggccgacacttagggaaaatagaaagaacctacgttgaaatattggggatgggttcccccgatagtgctgggagggcagcacgcctgcagtggacacagaagctctgagccccatacctgtcctgctcacctcttccatttggctgttcctttgttgtaccctgtataataaactggtaatcccaagaata

SEQ ID NO: 263119 - DNA, 641 bp, Homo sapiens
cccgagtcactcagctgatagtcatcagaaacaagtttcgaacctagtccagacctttcctgctcccacacctgagtgcttttctccatgccctggtgcagagaagttgctgggaatcttcacccagcttctcccaaagttaacctcctacaaaacatagtacattatcaaaatcaggaacctaatggtgatgcaatactatgaactactctataacttatattcacattttgccatttgtccacaaatgttcttttttgggtccagggtcccaacagcgtatttagttgccatctctccttgtctcctccaatctggggctgtttctcagtctgtcttccataacttcagaatattttaagagtactggtcagttatttgtagactgcctctcagatttggcgtgttggttgtttctttgtgattaaattctgattatgcatttttggcaaaaataccacagacataagattttactcttcttgggcatcctatcaagagatacaggatgacaggtatgtcccattacaggtgatgttaactcaggtcatctggtttaggtggtatctattagatatctccaatggaaagttgctgtttgcccctttgtgatgaataagcatcttgcagaaagaaacttt

SEQ ID NO: 263120 - DNA, 436 bp, Homo sapiens
ggttttcaccatgttagccaggctggtcttgaactcctgatctcaagtgatacactcgctttggcctcccaaagtgctgggattataggtgtaagccacagcgcccagccctatgacagattttaatttgatatttgtatatcttgcaggatgtggattaaggttgattttttatgcttttgagtgtccaattgttttggcttcatttgttaaaaagggtattctttgtctactgaatacttttgctcctttgttaaaagtcagttgaccatctatttgtgagtctatttctggattctccattttgtttcatttatctacgtccctattttttcaccaattctacatcctcttggttaccgtagctttagattaagtgttgaaatcaggttgtgtgaatcctccaatttttaaaatattgttttgatgattataa

SEQ ID NO: 263121 - DNA, 552 bp, Homo sapiens
gtcaagttcattatctttccttgagttactttttaaactccaaaccttttcagattaactctcaaggttttgcattgtgtatgattttttttttttaattttccaaaataagagagagtaaaaggtccctgtgtgtttaacatttaaaggcatcatttaaaaatatttcctaagaatatatgccccttggtggtgctgggtgtctcctgcttgagtcatcctaaaatctagccaactcagcctgcaaggagtatcaccaccacccgccaggatcagaggtgcgctggctgagctgggctgtcccggagatctggttatgggtggggagcagttgaaggtatgaggacaggctctgagagagccatggggttgacgaaagggcatcgagacagatgtcccagaaactgagtgagacccatcatgcctcactcaggcccccggggctgcatggggaagacaggacccatgtgtctgccagggcctagcacagagttggcaggggtggctagattctttgttctgttttctaataaattgcaactcacttccaag

SEQ ID NO: 263122 - DNA, 455 bp, Homo sapiens
attaatgaagctgttgatttttttttttttttcaggaagaatgaagaatggaagaatgaacaaactgcaggttagccaaatagtgcaagtaaacaaggaaagacaataaacaaatagccaaagcaattctgaaatggatgtaaaaacactgattttccttaaatgttttctcataattaaaaaaagtcactatccagagatcgtcagctattagtgaagtttttgtttctaatttttaaataaattatctgtttctgtgagcccaatgaacttgataacgctctcagagtctgggagccttgtcaaatatgtggggagctgcgtcttctggatgtggaatcacgctctccagtgctgttctcaccagcagtgttcactcctctcctgatccccttccactctgttatatttgtattttaatgtgtcccttttgattatcactgtgaactcagagc

SEQ ID NO: 263123 - DNA, 594 bp, Homo sapiens
gttaaaacgaaaaatgaaagcagtgtattctagatgtcatttcttggcagcagacacactaccttgctcatagcacttagaacaacgcttggcaattagaaaatgctccataaatattttgactgactccaggtggagaaatgttaattaagcattaatcatctaccataagcccacactgactgagcattttattcttcaacataatcctgtaatattggtatgataaacagattcaaaagtaagaaaagttagataagaaattcagtcaaaaccttcccctccacatgcatatactctcctacccatagcaaacagctcagatgcacctgctatgccgcctactatttactaagtgttcccccatgagttcccttcttgctctgactctgggtgagtgttaagctgctctgaaaattaagataagtctcttaagttgcatggcatggtttctctgtgactttagctttgcctctataaaagtaatgtcataagttaaagcatgaaacactcacttcacatgcatttgaggtgctttctgatcaacagcttcccaaggagatcatttacctgatttgttttcctacagccacc

SEQ ID NO: 263124 - DNA, 348 bp, Homo sapiens
gagagagggtcttggtctgttacccaggcttgagtgcagtagcacgatcttggctgactgcaacctccacttcttgggctcaagggattctccagcctcagccaggcatgagccattgaagtccagctaatttttgtattttttgtagagatggggtttccccatgtttcccaggctgatcttgaactcctgaggtcaaagcaatccacctgccttggcttcccaaagtgctgggatgacaggtgtgagccaacgtgtttggcccacttatttatttatttttaaatatagggtcttgcggggtctggtgcggtggctcacgcctgtaatcccagcactttgggaggc

SEQ ID NO: 263125 - DNA, 274 bp, Homo sapiens
gctaatcagagaggcaaatgatgaccctacaatttcagaaataatgtttgcatcatttgtggttgagctttggcatgtgagcgagtgttcctaaagtggaaccagtgtgtaccagcccagcacaaagtcagcactcagcatttgtcaccgtgtgaggtatggcaaggaagagcagctcctttcagactcaactgtagctctaagtgaaatcaatggccgaacaatctaacacaattggtcacatattgatagaattaaacactgctgttaacgt

SEQ ID NO: 263126 - DNA, 442 bp, Homo sapiens
gtaaaagagttagtttggagttaggagaagcatcagcaattatgttttcaggctgccatgttcctagaatctttgtctctacactgtaaatattattgatgaatagatggcctcttatactaaatagttttagactgtagcagagaaaacagtttaatggttaagaacaagacggaatcagactgttgggattcaaaccctagtttcgctgtttactacgtatgtgaccttgggcaagccatatagccatactgacttagtttcctcatctgaaaaatggataatgatgctattataaaaaacagggataatgataacactagtaatactcacatagtggtattgtaaagattaaatgatattgtaatttatagcaagtgttcagtacactacctggcacatgttatttccttaaataaactaaaataggctcatatgcaaa

SEQ ID NO: 263127 - DNA, 347 bp, Homo sapiens
agcctccagctcagccaggaaatgcccagtcccagccctgcctgggctggtaggtgtcgagtgatctgttagtggaaggtaacaatgacaccagctatatcaatgacactgccccggccagctgggaactgatctctcctctgcagataagaggaggagaaggaggcagacttgcctactaaattccatgtcttttcagccaatttcaaacacagaccagaggagggagagggagaggagggagagggagaggaggagcctttcccagggtaatccatttttaaaattctgtatgtccgattacttttgtggagacaaagggaaaagtacagaagatcacacgccta

SEQ ID NO: 263128 - DNA, 476 bp, Homo sapiens
cttggtcaagtaccagctctcatttatttctctgcaacattagaaaactcaaactcctcttctttaaaatggaaataatatctgttctgctgaactgagtgttgtgagcatcacatgaagtagggattgtgaaagtgacttgtaagctataaaacactgctgatggctgatgggagttgtcatggccgcttcagacccacagcaaagatttttgataaggcatgactcctaaacggatgaatgagtgccccattagagccaagattcttttattctttttgttgttgtagttgttgagacagaatcttgctgtcatccaggctggagtgcagtggtgtgttctcagctcactgcaacctccatctcctgaggcaggagaatcacttgaatccgtgaggcagatgtagtgagcagagatcaaaccattgcactccaccctgggagacagaatgagactccatctcaaaaaaaaaaaa

SEQ ID NO: 263129 - DNA, 304 bp, Homo sapiens
gagatggagtctcactctatcgcccaggctggagggcagtggggcgatctcagctgactgcagcctccacctcctgggttcaagcaatcctcccacctcagcctcctgagtagctgggatcactactccctgctaaccaatatggctttaaacacattaggtaacagtagaatccaaaactgaaagagcggggagctggagatcagtatccagatctttctactcaaggcaacattaacatgtccatctctgagacattcaataggcttttctcatgcaaagcgtcgacgcggccgcgaattta

SEQ ID NO: 263130 - DNA, 2711 bp, Homo sapiens
  misc_feature (2549)..(2549): n is a, c, g, or t
gcctctgactccatgcctcccacacacgcggtctgtgcagctaacaccaggcgcctacccggaggactcagctgttctgtttacatcgtggcggcacctctcaccctgacccacgcaaaggttctggagatttctggagaatatatttattaaagccacctcttcactgaaagttaccaaaagggtcagtttaggaagtaaatgaagggtcagtgaacagagtcaaacgcagaagtgggcttgttatgggtagggctttcagcatatgataaaaggatatttgttttttaaagtgttggaaaaactggttttctacttggaaaaagtaaaggttgtaagctttgtgtgtaaaaaagaaaaccatgaaggattggaagggaatgcaggtgtcgtgtttataaccttgtggttcgagtccctcttaacaaggactccaaagctggaaagcaggagggaacaaaggtgaaaattaaggcggggatgctcgggccctgcagtgcgctctaggctgtgcttgagccgggactgtgcccgcagcctgctaagggctgctttctcgggccagggaaagcggggcagcgggggacctgcggctgtgcctggactgaagccgtcccgcatgtccccaccctccagcatgtgttcacctgtccccctcctcgcagcagcctcaggacaaaacagaatgactcaaggacagcacttcctgcagaaagtctagaagtgcccagaatggaggcacgaagcccctcccagggaggactctccctcattgacggaccattcttggtgcagattcctgactgcacgcaccgaaccgtagacaagcgggcatccatccatgttgccccagagtgcccaggaggcaggcagcggggcgcccagacagacgggttcagcctgcaggactgcgaggcgacctgtgaaaccgacccaggcatcccaacaagaacaaaagcgtggtcctgtggccgtgtccacagcaagttccactttcaccttgctcatttctgcattgttggaagtgtttacaaccagcatgtgctttcataatacaacctcaggtaagaaaggaaaaaaattatagttgtatcatacctcaaatacgtttttaagttctacaatttaagctactctagaatagttagaatagttagaaaatggaaattttgcttaatggtgtttctaatatgaagggtacaagaattgtggtaggctctaactgttggcattaatggcatttttcttcatagaaacatgcaaaaaacaaccagtgttagatttctagaatgatcagacctatgcatatgtacttaattgtattaaccttgttgataatgttaaatggtaacatagagttaaccttagaacatttcctaacaattgatgtctttgaaacaattatttctgaggacaatacaggtaatctgcagtagctgaaagcaaattttggagtaaggtaaatttaagtttaaatcctcatgttgtcacttaaaaattatttgactgttgacaggttattaaatctctgtgtattttgtcacatgtgaagtaaggataatggaatcattttgtataagtaaaagaaaatgtcgtgtagttattcgttgctcaaaaacataccatgaatcattggaaggcagggactgtgacctactttccttttcatcctttcatcttagaataatgtctgctaaggtacttaatgtatgctctctgaaaaatgagtgaattaatgaatcttaatgtgtctttttcatgccctcataaatatgcatgtttaaatgcaatgaatcttactacataagcattgtttggtagctaggcactcaatacacattatttctactttctcaaggcatgtagaactgaatcgtaatcaatgatcaaaccataagtattctgtatctttagtaaaggctgtgaataaagagtagcattacttgttcattcatttgaacctttattgcatgaacactttgcatcagataatataccagcaaatgtactagtgttgttgttgttttggacatttggaaatttctgtttgtcttcatgcagataaagtatcttggtagtaattatttttttcacatgaacatttgaaaacctgtagaaaaggccgataccttttgctcagagatacctaaaatatattacagggtaataaaataaatcaactagatcaataagtttggtattgttaattttaaagtaactttattttataattgacatgtgtagtttgacaaattaaatgcaataccaagcttaaaataaaaatacagtgatactgtcccatcattccccagtcttacttttctatcctgggggcaaacacttttgaatctttcagttgcttaatttggcatttatatatctccatagttttatataatatgtaaatatagctattttgatttataaatgttaattattatcaaacttcaagttttagcagaagtgtggtgatgaatcagttttaaatccatctctcctaaaaactgtagataaatatacacacatacttgtgtgcatgcacacataanacatgaagagtgcttacagttactacactgattgacttcatcttctggtaagttatagatgaactctttcatgatgccagttctatgtttttcctctttccaatgcctgctattgttatgaaaattttggttaaatcgatattgaataaacatcatgcattc

SEQ ID NO: 263131 - DNA, 511 bp, Homo sapiens
atgcttcggatatctcaagaaatctctaggcaattcaaggaaaaaagccctcgtctggcagggaacacctgaaaaatcaccctggttaacagaaaatctgcgtgtgatcttaggcaagccattaaatctctctgggcttcaacttcttcctctgtaaaaggaaggagttaggtgagcaaaaaattccatacccattacaggtcaatgcttaaagaagcaacgaggaaggaggtgtgatcaaaggaaggttgactggtggaccacccagagaactcttcaaggctgatgttttcttggtgaatgaccctaatctaggcctagcttttggcctttcaggtttttgaccttcctaatgtccaaagaggtgtagacattctgtgatggttctgacctaaccatttatcaaaccctctgtacacttatgaattgactattaaaatcagaacactcatatcccctatacaggtactacttccagacccttcctgttattaagtatcccaggaagctg

SEQ ID NO: 263132 - DNA, 425 bp, Homo sapiens
gaacacagcgagctgtctctgtttaaaaacattccagagttgaagtccagattggcctcacataacccacagtggggctgcaaatcattgacagttggttacaaaaataaacaatcagaggctatgacatttctagactggcacggtggctgacgcctgtaatcctagcactttgggaggccaaggtaggcggatcacctgaggtcaggagttggagaccagcctgaccaacatggtgaaaccccgtctctactaaaaatgtaaaaaattagccgggcgtggtgggcgcctgtagtcccagctactcaggaggctgaggcaggagaattgcttaaacccgggaggtggagcttgcagtgagccgagatcgtgccactgcactccagcctgggtgacagagcgagactccatctcaaaaaaaaaaa

SEQ ID NO: 263133 - DNA, 506 bp, Homo sapiens
gggaaggaaatggagggcaaaagaaattgagaaaaaaatgagaaaggctgtaaacctaaatctaggattataatctttgatgggaaaagtttccctgtctctcactaaaaaaacaaacaaacaagaaaccttggataatagctataaaatgttaacatgcaataaagtacaaagcctcttgcttaaataaggaaacatataatttttgtggttttatttaattcatttctttttattatttattttattcactattgggtgacagcataaggaatatcagatggggttacactcagacatgtccctttaagtgtgcactttttaatcagtctttttttttaatggtacaattgaagatgtctattattggggccatcaccacttctttcagtgaattcattgaaaaaatcttggttggttttgataaaaatcaaatgaataattgcttctcgttatcatatcagaaatgcagatgcacgtttggttgacaaaacacactgaatttg

SEQ ID NO: 263134 - DNA, 1648 bp, Homo sapiens
  misc_feature (1)..(1): n is a, c, g, or t
  misc_feature (4)..(4): n is a, c, g, or t
nggnagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacaatcatggctcactgcaaccttgacctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattac

SEQ ID NO: 263135 - DNA, 1156 bp, Homo sapiens
  misc_feature (1)..(1): n is a, c, g, or t
  misc_feature (4)..(4): n is a, c, g, or t
nggnagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccaggtcagctttgttgttttaaattttcaacttttagattcgggggtacactgtgtaggttcattacatgagtatactgtgtgatgctgaggtttggggtaggattgatcctgccacccaggtactgagcaaagtacctaatagtttttcagcccttgctgctctcactccctccctctctagtagtctccagtgtcatttgttcccatctttatgtccatgtgcacccacatgtttagctcccacttatagtgagaacatgtatttggttttctgttcctgcattaattagcttggaataatgatctccagctgcatccatgttgctgcaaaggacatgattttgttttttatggctgcataggacagctttattttcactgttcagtgaaggagtttttgggggtgggtttagtaactttgaggagaaaaagaatttaatgaatattaaatcgtaaaccaccagtataattcca

SEQ ID NO: 263136 - DNA, 463 bp, Homo sapiens
tgtaatcaatagacaactattggaaatatggcatatgttgacaaacacttaactagggaaatcaaagatataaatcatgtttataaaaaattaggcacgcaatcatgtgattcatgcttcaagaaaatatatgaaaaaagtgttactccattgtgttataaactagcagattttccctattttgaaatgcatgtaaacgggctcggctgattctgaaattgtactgtatcctttggtatttacttatatggtcaaatacttgtttgtaaaagtgatggttctgatacctttgatcaaacatagatacaaacctcagaaaatggtaaatgcaaagcagtttacgttgtaaatcatgatggtgtcctccagcacaaccatcccacccacacacctagactacagattctgatctgtgaatattttcaccaaagtgacatttaaacaagtggatttttcacaaata

SEQ ID NO: 263137 - DNA, 607 bp, Homo sapiens
agagacagcaggttgtaaaaatgtttcttcttactggacttaaaaaggtgcctggctcttagttgattgattatctcctggatctggaatgtaaggaaggaaaacaaaagaggaaaggggattgtctatagaatgtacatttttcccacaagagacttttgcagggcaatttcaaggcatggcaagaaaatatattttggtgttaaatattttgattttttttttcttgtctcataatgttacgccagagtcagattggaaagtaagtcacgatctatagggtcaaataaaacccatctgatgagaatttatggtttgtagggcatgaccccttcaaacaattagatagaaatttgggcaagataaaaaattcagagcttagtcctcagttcctaaataagatggctacaagaagaaaagctacatacctcccccatcttttgcccacaagaaaatttctagtgagccgcaagatctttaccctaaggtgtttctgttaaaatgtaaactgatagcttatctttacagatacagtcacccccctgcccaacagacacaaatgcatatctgattgttcccctgcctcgttttgtcttgtcttatgtta

SEQ ID NO: 263138 - DNA, 1388 bp, Homo sapiens
acaatttgtagtaccataaaaacataaaattctcagaaataaatttgataaagtttagcctgggagcagtggctcacgcctataatccaagcactttgggaggcagagatgggcggatcacgaggtcaggagatcaagaccatcctggctaacaaggtgaaacctcgtctctactaaaagtacaaaaaattagccgggcgtggtggtacatgcctgtagccctagctactctggaggctgaggcaggagaatcacttgaacccgggaggtggagattgcagtgagctgagatcacgccactgcactctagcctgggatacagagctagactccatctcaaaaaaaaaaaatggttaaaatttgtgtaatacttataaattgaaaactataaaacattgctgagggaaattttaaaaagacttaaataaatggagagatacactgtattcagaaattggatctattaagatgtttattctttccaaatcaacctatagagttagtgcaatatcaaagtctcagcaggcaaattaactcgctgattctaaaatttgtaaagaaaagcaaaggacctaaacttaaccaaaatattcctgaaaataaaaaaaacggttaggtgtggtggctcacacctgtaatcccagcactttgggagtctgaggtgagtggatcacttgaagtcaggagtttgagaccagcctggctgacagggtaaaaccctgtctctactaaaaatacaaaaatttgccgggtgtggtggtgcatgcctgtaatcccagctaccctgaaggctgaggcaggagcattgcttgaacccgggaggtggaggctgcagtgagccgagatcgtgccactgcactccagcctggattacagagtaaaactgtctcaaacaaaacaaaacaaaacaaacaaaaccctaaaaaaccacaaaaccctttgaaaaaagatggaagactcagactagtaaatttcaagatatgtaatagtaatcaagatagtgtggctttggtgtaaggacacaagtgtagatcaatggaaaggaatagtgagtccagaaatacatacagccaactgactttcaagaaagatgccaagataattcaatggggaggccaggcacggtggctcatgcctgtaatcccagcactttgggaggctgaggcaggcagatcacctgaggtcaggaaatcgagaccagcctggccaacatggtgaaaccccatctctactaaaaatacaaaaattagctggacatcatggcacacgcctataatcctagctactagggcagctgagacacaagaatcacttgaacctgggaggtggaggttatagtgagcctagattgtgctactgcactctagattgggtgacagagccttctc

SEQ ID NO: 263139 - DNA, 364 bp, Homo sapiens
tgtatttttagtaaagatggggttttgccatgttggccaggctggtctcgaactcctgacctcaagtgatccacccatctcggcctcccaaagtgcagggattacaggcatgagccaccacacctggcttgcctgtaatatctaataacttactttatcctaagatcacataaaacatgtatttgttttgttgggggaagtctagagtgggtttattttcataaaatgggaactgaaacttagtaaatgagcatgaatcagcacagcctactggctgtgaatgtctctttttggcctcttatagatttctttcttcaccctctctcataagactagagaatctataatctggatgttaatttta

SEQ ID NO: 263140 - DNA, 538 bp, Homo sapiens
tggggtgagaaaaatgttctgaaatgtattgtgctggtggttacacaacattcatgctgattatatattaaaaatcattaaactgcacattttaaataggttaattgtatgacatgtgaattgcatcttagaaaagtcgttgtataaaaaaatcaagccacattgtaatggaggccagaatatactattaacaaaatctttacccattcacacctctgacaaacatatatgggaacagctaggcacagtggctcacgcctggaatcccagcactttgggaggccaaggtgggcagatcacttgaggtcaggggtttgagaacagcctgaccaacatggcaaaaccccgtctctactaaaaatacaaaaattagccgggcgtggtggcgggcacctataatctcagctacttgggaggctgaggcaggagcatcacttgaaccctggaggcagaggctgcagtgagccaagatcataccactgcactcctggtgacaagagcctgggtgacaagagcaaaactctattaaaaaaaaaaa

SEQ ID NO: 263141 - DNA, 382 bp, Homo sapiens
ctgcatcgtcccatggtggaaagcagaagaataagggagtgcacacacgagagacagatggaacttgtaccctgaagcctttctataatcagccttaatccattcatgtgggtggagcccttatgacctaaataccttccattaggcctcacctcccaacacttttggattaggggttaaattttcaacacatgcttttgggcggacccattcaaaccacagcaatgtatgtgctgcaaagaacaaagattttgggatccaataggtagaatttagctccacattgggcaagtcatgataacttcctaagttttggtttcttaaatggtaaaacagatgtaccaatatctaattcagcagattactgtgagcagtctgagat

SEQ ID NO: 263142 - DNA, 413 bp, Homo sapiens
ggataaatgccttctccccattatttccttcaatccctacaatacccctgtgaagtaggtatcattcgaatcacattttacacggggaaactgagactcagagatcacagctccggagctcaggcttttggcaataaccctccactgcctgcctccgcaagacagcaaaaggttggctttgttccccaagtcatccagtttcccacagtgatgggttaagcgtcataacccatggctttatccaagccatttgaattgaagaggaaggtggacgcagagccagcatggttagggccagtggcctttccagacttgcgtgccaggagagatgggttagcgtgggggaggccggagaaggggttttcaagtgaccccggtaggacccccacgtctctctcccgcctttgctcagc

SEQ ID NO: 263143 - DNA, 344 bp, Homo sapiens
catggatggatttgtcaaagatcaggccacctcatctcttccattggccaccagtttataaaccaaagagtatctgagacaggtctcaatcaattcagaagtttattttgccaaggttaaagacatgcctggaagaaaataacatggacccacaggaacagtctgtggtctgagtctttctccaaagataaatttcaaggcttcaatatttaaagggaaaatgtaggctggaggggagaggggtagagtatagtaatccccatgttgtaagagaaaaggagcgggtacgggaatagtcaattatgtattcatctcatgctcaataaattggcactttacataag

SEQ ID NO: 263144 - DNA, 282 bp, Homo sapiens
aattctcctgcctcagcctcccgagtagctaggatcacaggtgcccaccaccatgcctggctaattttgtatttttggtagagacggggtttcaccgtgttggccaggctggtctcaaactcctgatctgcctgcctcggcctcccaaagtgctgggattacaggcgtgagccactgtgcccggccgagtctaaacatttttaaactctcagtgcatactgtcatgttatctttcagagagttgccgtcagtttaaattctcagtggtagggattgcgagtg

SEQ ID NO: 263145 - DNA, 440 bp, Homo sapiens
taaaaacaaaaatcaaggcatcttcactcagtcttcagctgataaaaatgttgacaacagtgggagaaactcaaaactcacatgttttggctttctttataaagggaaaggccatagatgaatttctaaatttaaacctccatctccagagacacccttctcgttgctgattcagtttcatctcatgaatacacagggtcttggataggattctgcatgggcagccaagatatctgttgtattcctagctgtgttttttatttctaggttgccctgggacactctctatatatcattttccctgaacagaaaccattttgagagtaagtacaacagcattcgttaaatgctctctgctcttcaagggcaagatgttgttgtcaagtttagtagaaaaacaattgaatgtaaaatgggctcattgattaaagctatacaac

SEQ ID NO: 263146 - DNA, 314 bp, Homo sapiens
aattgcagaaaattagactcagaaaaaatcttgaaagaagccacaggaaaagaacattttacctgctgagaaacaagggtaagaattatatcaaactttcttccagaaaccatctaaggaagaaaagaataatgtaaaatatttaaagtgttgaaagaaaaagccagcaacccagaattctgtatctcataaaattatccttcattcgtgaaggagaaataaagactttttcaggcaaacaaaaattgagcgaattcattgccagtagacctcccttgcaagaaatgttaaaagttcttcagaaagaaggaaaa

SEQ ID NO: 263147 - DNA, 403 bp, Homo sapiens
atgtttagttcttgccgcccaggtatcttgtgtccatttcttcatttcaggcagagcttggatccaaaaatggagtatctcagcaattctgagaaatatttaggaaagtaatgggatgttttggtgtatgaatattgtgggaaccaatttataatttttatatgtacagggtattttggaattacataaagatgaaggggacaggttaggcaatatgactgattttttgtagaataaaacagcaccatttcagagatagcatggattgcatccaggctgacataagtaggcaggattcaatctcattgagtgagacatagtagtagccttaagtggcaccacttttagttgaatggaagcatatttgttcttggggttggagttggaccaaggtcatagatac

SEQ ID NO: 263148 - DNA, 454 bp, Homo sapiens
agtattattttatgtgatcccacataggagagcttaatatttaaacagttttatgctttagttgattcagagttcacatactctttggaccttagagtatgaaaattgatacatctttaattatcctggtgtagtctaaagaacccaaattttatagccaaagagactatcctgatattttccctggctttgtaaactcggatagattgcttattgttttttgtttgtttgtttgttttttcttgagacagtgtcgctctgtcgcccaggctggagtgcagtgtcgcagtcttggctcactgcaacctcaacctccagggatcaggacctctcattctcagctacttgggagggtgaggtgggaggattgtttcagtttaggaggttcaggctgcagtgagacaggaccactgcacttcagtctggtcaacagaacaagaccttgccaaaaaaa

SEQ ID NO: 263149 - DNA, 372 bp, Homo sapiens
ggatcagacaggttgagcttaagatagccatgagacatcaactggagatgtctagtagcctatttggtagttgtcatccctagggtaaccaattcatttccgttttcttgggactttcccgattttaaacagtgaaagtttcttgtcctgggaaacccctcagttcctgaagcaactgaagtcatgaacatgggggataattcacacaatgagaaaagcagtcagtttggccaggtctgagccctgaggagctccagtaataaaggcagagcaagaccacttcatctcctgctgggctgtggactccctgagggcaggcaagcataatccatgagggctgcccaatcacacttgttaggaatgaaaggaaaa

SEQ ID NO: 263150 - DNA, 384 bp, Homo sapiens
caggggcaggaaagcaggaagtaaggaaatgtcaactcttggacttctgagtctgacttaggaaaaattaaggatggaaaggtcagttagggcctaattttggagtgtccagattccctgagagcgtgcttggattttatttgattagtagtggggagctattgaaagttttgagctggacaatgacattaattaactaattaatgcaacaaatatttatgtgtgtcaggcactgttctaggcattttggggtataacaatgagcaaaataaaccagaaaaaaaattcctgcttctaaaacttatgttttagttgaggaggcagtcaatattactatgtgtaataagtatatcatatagtatgctaggtaatatattctgttga

SEQ ID NO: 263151 - DNA, 497 bp, Homo sapiens
cgagggtaagaacgtgccttttctttcttacacattcccagaagacccacattcctcattgggctctctgtaacagtatttactaagcacttgaataactggacatgggcaccatgttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttct

SEQ ID NO: 263152 - DNA, 364 bp, Homo sapiens
cttgttgggctaaaacagctcctgacagaccccaagcagtgtagatgaacccaagttaactttccttattaacatgctgaagtctccactctggaaggagctatagcttcattaccataacatgctttctatgtgctggtatgactcactgcatctgtgcaactgggaccccaattctacatgcactgatgcaccttctcccatcaccattataccataaaactctcctgttacttgtcctcagggagacactgctttggagaatactcccagtgtcctctttacttgagccaagtaataaaagtattgatcaatacctgtgttctctggccgggcgaggtggctcgtgcctgtaatcccagca

SEQ ID NO: 263153 - DNA, 443 bp, Homo sapiens
cagcaagggggaattattttccttcccctagagctgctgggaaaacgactccctgcttgcctatgcctggccagctgggaagattcttaaataaccgactggacaccggccccaggccacgcagtgctcccccagtaaaggataggtccacgtctttctcagtcctggccaaaaacgtctgtgaacacacccactagaaacaagccaggaacaaaccgctgctctgaggatctgattacatttccccagggcaggtttccaccagagcgagcgcccctccctcctcctttcccagaactccgttgcccaacaactgttccagctcctgctcctgaggcgggggcagcctgaggaaaccagggcctcaggcgacagccggctctgttaggcaggggcaggacaaagtgcaaggtccctctggaatcccccaaggcagagggcag

SEQ ID NO: 263154 - DNA, 210 bp, Homo sapiens
gtgagcatccttgtcttgttctaattctcagggggaatgcactcaactcttccccattcagtataatgttggctgtgggtttgtcataggtggtttttattactttaaggtgtgccctttctatgccgattttgctaaggtttttaatcataaagggatgctggattttgtcaaatgctttttctgcatctattgaaatgatcatgtaat

SEQ ID NO: 263155 - DNA, 444 bp, Homo sapiens
atgtctcctcaactagttacacagctcttcccagcactgtttcctttctggaaacctcacaagtgaactttgaagaaggaatctgtatattcatgagtagagtttagtaaatgacttcaccagttagggggtcaaccatgctaacagctcaaatcccttgaaccctcttcactgccctagagttggatttggtgtgattctcttcccacgaatggagtaaattcagagaagcacccagaggaggaagtcaatgcccaatctgtagaaagagaaattagcctggacacagcaccacaggctatagtgcagaactgtgagaaaccttctgaatcatccaaggaaaaagaaaggtacaccttaatgagaaaagaaatttctgcagtgtccctgaagtcttcaagatcccagaaatcccttggaaacgtaaaacaaaacaaaacaaac

SEQ ID NO: 263156 - DNA, 359 bp, Homo sapiens
aaatctcaaagacaactgaagaaagtagttgttgaaagttgttctaaaaaattgcctgactaaaatgggaggatgggcaaaaatcatttgcataaccacttgcctatatcaattaaatttcaattttatgcatttctcaggcctttaaacttaaaacaattttccaaatattaatggctcatttttgacacaatctttcttccactgctcaacctaaatcctcctctggctttaccccccacacttaggaagagaaaggataaaagggtaaagatagtcatacatgacccccatgaacaaaaatagtagtcaggggaaaagacacagatgtagagttgggtactgagtctgggtggggt

SEQ ID NO: 263157 - DNA, 442 bp, Homo sapiens
gacttgtttttgggagtaaaggacaggctagagttaaagacaaagcctaggcttctggctaggaaaactaggtgggtgatgttatcactcactcatatggggaacaaagaagagaagcagatttggaagatagaatgataagtttcattttgtgcatgtttaatgtgagatacttttgaaacttgtgatactcaagagaatgtctcaccggggacggtgcctcacgcctataatcccagcactttgggaggccaaggcaggtggatcatctaaggtcaggagcttgagaccatcctggccaacatagtgaaaccctgtctctagtaaaaatacaaagattagccaggcttggtggtgtgcacctgtaatcccagctactcaggaggctgaggcaggagattgcttgaactagggaggcagaggttacagtgagccaagatca

SEQ ID NO: 263158 - DNA, 281 bp, Homo sapiens
ctcttcttttttgcaaatgtatttatgagtaaaactgtaaaacagtatagattacataagccaaatcatctatttcttaatatataagccaacttagtttctattttcatttgcttaatacatttttattgagcacatactacatgataagtactgttttggtgctgcatgtacaatgaagaataaaagagacatggtctgcctatatgagagctcacagtacagacagtcccagacttaggatggtccagcttaacaatttttagactttatcatggtgc

SEQ ID NO: 263159 - DNA, 234 bp, Homo sapiens
acccaaagaacagctatttggtcaacagatttgcattggtatttaccttaaagactggtttatatgaaactaaaatagtgtaagagactttgaggaaacctatagaagacaagtttagttgttttatatatgtaaggaggaaatcaggtttattgaaaaccactgcttatgaacccaaccatgcctcttaatttttattaaaatacttgtcactgaaataaagtaagttttttc

SEQ ID NO: 263160 - DNA, 368 bp, Homo sapiens
ctgggtcagaacatattttctgcttgtttgctgcatcactttatgtccacagttcttagctagaagttactctgtcccccagcagaggatagctggcaaagtctggagacatttttagttgttacaattggcaggtgctgaggagaaggtgcaccagtgggtagaatacacagatgctgctaaacacgccacattgcacggtacagagcccacaacaaagaattatccagcacaataatgcgagttaggaaatcctattttagataaatcagctcaatctttattattcttggcttctgtatgaaatacttgtgtttttgaggatagtaaatgagattgctatgaaagcacacagtaagtgataaagt

SEQ ID NO: 263161 - DNA, 268 bp, Homo sapiens
tcttttgaggctttccaggggcctagctagaaaatccaagttagttctaggtcaaaaatatttaatttagaattttgatattggggagggaggtctatcaaagatgtgaaaaggtttaaaacacctgatcaaaacaggatcacaggtcactgtgaaatgatagtcattcatttaaccagaatgataatcagaggacttcaaaagcaatatagaaagttacctggatttaaaaaacattaaccctttcaaagctattttcctgagtaat

SEQ ID NO: 263162 - DNA, 436 bp, Homo sapiens
aagcatccctgtatgtgttctgttgtatagttgttactcataacttgttacctctctttttttttattattattgtttattaactatgacacaattgcactggagactggtcagctccccatcatagtagctaaggacctgcaatttggaactaaaaagatcttgatttgaatattggtttcaccagatactcactttgcagccacaaacgagttttgtaaccttgctgcacttagtttacatctgtaaaatgaagaaaatgacagtatctacattataaggttgcaatgaggattaaatgagatgacacttgtaatgtgcttagcaatatagcctggcacctacaagcacttaataaagccagtgtggctattattctttatctacatttaccaagttcctcctatgtaccaggcgtggtcctgggtattgggga

SEQ ID NO: 263163 - DNA, 418 bp, Homo sapiens
tatccaagccttaaaggttgggggcaggatttgactataaagggatagcacaggacaatttagggagggaggcagtgatagaactgctctgtaaatgctgactgtactggtggttttaagattctatatatacatttggtaggccaggcacggtggctcatgcctgtaatcccagcactttgggaggccagggcgggtggatcatgaggtcaggagttcgagaccagcctggccaacatggtgaaatcccgtctctactaaaaatacaaaaattagctgggcgtgtggcacacacttgtaatcccagttacttgggagactaaggcagggagcattgcttgaacccaggaggcagaggttgcggtgagcccagatgcactctagcctggtgacagagtgagactccatctcaaaaaaa

SEQ ID NO: 263164 - DNA, 168 bp, Homo sapiens
atgtatacatagaaaaattagccagacatgttggaccatgtctgtagtcccagctattcaggaaggctgagatgggaggatcacctgagcctgggagttcaacgctgcagtgagccacgatcgtgccactgcactccatcttggacaacagagtgagactgtctcaaa

SEQ ID NO: 263165 - DNA, 183 bp, Homo sapiens
tgaacctttacggaagttgattaccctagaatttttataagagcattagaatttgccagctttcttcaagagttaatataggccgggcgcagtggctcatgcctgtaatcccaaagtgctaggattgcaggcgtacacctccactgccaataaatttttgttcagatctgtgtgcctgtacaa

SEQ ID NO: 263166 - DNA, 501 bp, Homo sapiens
ttatgagtaataaagtataaggggaaaggcttgcagagagaaaaagcaaggaagagaagtatgtcaatgaatacaaattctctcatttgataagaaaatgtaaaattatgaataaatgtatgacatctcattgcaagatatgataagactcaatttcccctgtttattgtcaccgaatatctaggaaacaaaaattttcaggacttcagtattttagcaggaagaaatctagtgactatagattgcctacccctcaccatctcaccagtgaaggtcttggtcagtagtctgtagctctccattttctgccccctaaatgtgtcttgcagtgagtggtcagtggtcaaatgaatggaacagtagaggcacttctatatcagcatgaaaaaccagtgaaatgctgtcttgccaatactgtgtatacagagagacatttataaaataataagcaggtaaaacttgtcttggcaaaaggctggctcattacattcagtgaatgtt

SEQ ID NO: 263167 - DNA, 347 bp, Homo sapiens
agaattctgcaaataactagagatgtgaaaagaaaaatgaagttcaagcattccaatttccaagttagaaattggaaactgtttcccaaagaagcagctggataaataatggccaagttctgcaataatactgttgctacattttaattacattttgatttaggtagaatcttgcaggttggttttgtatcctaaccacattcatcatgcaggttttatggagaaatatgttccaaattctaacagtggcttacaaatgaacttgtagagcacaacctgattgcaatttggaaatggcttgcaaatactttatttttattaatattttatttaaaatattggaagat

SEQ ID NO: 263168 - DNA, 471 bp, Homo sapiens
tgagtttgaaaactttattatctggctgttttgtcaacatgataatttcatatacaaccacgtaaaaacatctctggtgtttagatttttccgtttattctagctgtttcatatttgtagacgtagccatggcatgtacagaatatgcatagcaacaggactttcatataatatagtacagttggaaaaaaacactatcttgctagggagatatgtcaagtagattctagtttccacattattttgattttactgtatttaactttgtatatattttacatgtattaaatgttttgatgaaacatttcaaactctatattagaaatgttggcaaacattagtatctataaaatataatctgtatatattgtataatctggatataaaatatccagaaatctgtcatatttttataccaattacaatggtcaaagttgacactattcttaaatatacttaatgattatctgg

SEQ ID NO: 263169 - DNA, 229 bp, Homo sapiens
tgaaaaattagttgcatttctatacactaaaaacaaactattctgttgtttaagccacccaatctatgatattccattatagcaccctgaactgactgagataatgcctaactagcaagagactgaaaatgttactttttggattccatatttatgcactcaaaaatatttactgtgtacttattatgtgccaggaacctttttaaggtgctggggctggagtgatggc

SEQ ID NO: 263170 - DNA, 432 bp, Homo sapiens
caattctgttgggagaggtgaaggccataagctaatagatgtatagtctttgttttaataagaaaataaaaaatttttataattagcaaaattgttgctaattataggaacaattttgcacatgaacaaactgctatctacaaagaagcaatttgctgttcttaattgtactaaaagtaattgccttgtcttaccattcatgtggttaggaaactcttcacttcaaagatacacttcagtttagcaattattgccaactactaatgtctaaaattggaatgagtatggcatttggtactgttgttctttgttgaactctagttttgtttataggtaaagagatgaagaaaataatctttctaccagatatccattcatggtctactaactgcttctaggaaataatactattaaataaccatttcaacctgc

SEQ ID NO: 263171 - DNA, 505 bp, Homo sapiens
cacatcatgtgattgtagggaaagcctaggctatcatggagggaagagattggataaattatttgaaaagcaagcctgtgaattgctgtggaggaacaatagcctgtctcttatctggagcctttccaaggaaaagcaaaggggaccctagaaggcttcctgggagacagtttaattctgaaaacaaagcagtacttcacctcttgtgtgttgggtagagctgtaaaacagaacacagtcaaaatagtcattagggccacatcaatgtctgcccaaagtcaggcgagcattcccaggaaggtggggggctgtggcagttgcacacatcaacctcctttctccattgtcacacagcagaagagcgtgttccattctactaaagttggggcggggggagttgaataatttattgactgaaaactgggggcctgagttagatggtaaaaaagtttagagtgctgttttttgttttttaagttatgtttgttttatatattgaagtgct

SEQ ID NO: 263172 - DNA, 376 bp, Homo sapiens
tccatacaatacatttcatccttgtagccctggaacattaaacagtgcaatgcactgctgattttgttttgttttgttttttgaagcagagtcttgctctgtcacccaggctgaagtacagtggcgtgatcttggctcactgcagtctccacctccagggttcaaatgattcttgtccctcagcctcccatgtagctaggaccacaggcacaagctaccatgtccagctgatttttgtatttttagtagagatatggtttcaccatgttggccacgctggtttcaaactactggcctcaagtgattagcccgcctcggcctcccaaagtgctgggattacagatgtgagccactgcacccagccttgcactcctgt

SEQ ID NO: 263173 - DNA, 89 bp, Homo sapiens
gatgttccagaaagctgagtctgatctggattacattcaatacaggctggaatatgaaatcaagactaatcatcctgattcagcaagtg

SEQ ID NO: 263174 - DNA, 390 bp, Homo sapiens
gcagcgctcccgcagggctgagtgtccaaagccaagtagaatgctcagggtgccgctaggaagagggcgatgggcagagcatgctgctgatgtgctggggccatctcagtcttgtcaccaagaggaagccacctaaccctcactggaaactcacaactacttagtcaaaaaatgggccaaaacattcataatgggtgcataagcaggggcaggggcggaggtcaggctgagcaagatgagaagtcaggtgggactgggcaggacaggcagggagggtgctgctgcaggtgtaaagtgaaccctcgggcggccggagagccaagttcccaaccaagagaagcaagaagaagatgagccccgaggagccacctcagcaacaagtgcaggact

SEQ ID NO: 263175 - DNA, 194 bp, Homo sapiens
ggggtcttcctatgttgcccaggctggtcttgaacccctgggctcaaacgatccacccctctcagcctcccaaagtgctgggattacaggcatgagccactgtgcccagctggaaataaacttttatgtgttaagtcactaatattttgggtctgttgccacagcataaatccagactacccagacactttccc

SEQ ID NO: 263176 - DNA, 301 bp, Homo sapiens
caaaaaacaaaaaacaaaaaaaaacctgatgccgagaatggtacgtaggtttcactgatgcccgtggggtctaccgcacagacaaggaaagatctctgcactagaatgtggagccactggccaggtgcggtggctcacgcctgtaataccagcacttggggaggctgaagtgggtgggtcacgaggtcaggagtttgagaccagcctggccaacataatgaaaccccatccctattaaaaatacaaaaaaattagccaggcatggtagtgggcacctgtaatcccagctactcgggaggct

SEQ ID NO: 263177 - DNA, 380 bp, Homo sapiens
atgtgcaggagagggtcgtggctgaggtcaccctgggtacggtcaggatggagtagtaactgaagccagggcttggaggtggtcagctgccaggggtcacagaggttcagggacaagaagagagagcaggtgtccctcgacttagccaggtcatggtgtctcagcaggagccattccggcacagcccgaggcaaggcgagggtgagatgaggtagcgagggtgggtctgcctagggcatggggcagggagggcaacagggaggcaccagaggacggcaggatgggaaggagatgccagggtgggcgtcatggagatgccagggtgggcgtcatggagatgccagggtgggcatcatggagaaggcaagggtcactggagc

SEQ ID NO: 263178 - DNA, 431 bp, Homo sapiens
taaccagctgaataaatgaaatgaccatgaaggattaagtgagacctgttgtaacgtttcataaacccatcagttttttaagtgtgcatgagaatgggccatcaaatatagctggttggagtcccagaaaacttggcatgccttaatgtttgaaaatcccaggcagagtacagtggcttacatttataatcttgacactttgggaggctaaggcaggaggatctcttgaggccaggagtttgagacagcctgagcaacatagtgaaacaccgtctcttcaaaacaaaacaaaacaaaaaaagtagctgggcatggtggcgtgtacctgtagtcctagctacttgagcctaggggttcaaggctgcaatgatctatgattgcatcactgaactccagccagggagacagagtgagactctgtttcttaaaaa

SEQ ID NO: 263179 - DNA, 507 bp, Homo sapiens
atgaagaagttcttcaccgtggccatccttgctggcagcgttctgtccacagctcacggcagcctgctcaacctgaaggccatggtggaggccgtcacagggaggagcgccatcctgtccttcgtgggctacggttgctactgtgggctggggggccgtggccagcccaaggatgaggtggactggtgctgccacgcccacgactgctgctaccaggaactctttgaccaaggctgtcacccctatgtggaccactatgatcacaccatcgagaacaacactgagatagtctgcagtgacctcaacaagacagagtgtgacaagcagacatgcatgtgtgacaagaacatggttctgtgcctcatgaaccagacgtaccgagaggagtaccgtggcttcctcaatgtctactgccagggccccacgcccaactgcagcatctatgaaccgccccctgaggaggtcacctgcagtcaccaatccccagcgccccccgcccctccctag

SEQ ID NO: 263180 - DNA, 197 bp, Homo sapiens
gtctgattccaggacactggtacctgtttctgtgctcaacgttcagatcctacaatccagtgctaaaatgaacagtaagagatatgaagaaataggaaacaggagttctggctaatggtcattcaacataatgacattaggtaagtttctttgtgcctaggtctcccatttgtaaagataacctgcagcagcttaca

SEQ ID NO: 263181 - DNA, 876 bp, Homo sapiens
cgcccgcctcgtcttcccaaagtgctggaattacaggcgtgagccaccgcacccggctccttctagaagttttatagtttgagattttatacgtgttctatgatccattttgcatcaatttttctatatggtgtgagttatgtgtccaagtgtgtttagcaaatggtatttaattgttcaagcaccatttattgaaaagattctccttcacccccactcccactgaattgcttttgcatttttgttgaaaatcacctgcctgtgttcatgtgtaggtctgcttctggaatctctatttcatcacactgctgtacatatttacccctttaacaatagaacattatattacttaatgttacataatttcatattgtatattaaaatctggaagtataaaacctctagattggtacttatttttcaaaattgtttgggctatcctagattttttgtgtctccatattcattttagaatcagcttttcaatatataaaaaaacttgagaatttgattgagattgcattgaatttacagaccaatttggggataaaggtcatcttaaattcagccttccaatccatgaacatattttacctctccatttattcagatcttccttcatttccttcagcaataaagttttcagtgtagagtttgtgcatgtttctattaaacttgttatcaagtgtttcgtgtttttatgctattataaaatgacatgccatattatatatgctattttaaaattttactttctggttgtttggctgatatatgcaacataaatggatttttgtatacatatcttgtattctgcagtcttgtttaactcagttattagttctaatgacttaaataaatcctttagtatatact

SEQ ID NO: 263182 - DNA, 303 bp, Homo sapiens
gaggacgaccttgtggctggcaagtgtcctggaggctggtccctcaggaccctccctgtcctcatctggaattcacctttcttctgagcacagcctgtgtggcgtcgtgtgctctgatggccttacccagaggccaccttggccgccggccttgctttctcctgtttgtgggctgcgagctgtcattacgtgactgagtcctgatcaggcctgggggagcccgattctaacgaccctgaggctcatgagggaccccgtctctcctgctgtgtctccccgcggacccgcgctctccttccttca

SEQ ID NO: 263183 - DNA, 480 bp, Homo sapiens
cgtttttctgaccctttggccggaacttgatctcttggctccctccttggccacccaccacctctcgcacagcccctctgtttttacaccaataacaagaattaagggggaagccctggcagctatactttttcaaccaaactcctttgccgggacccagcccgacaccctgctcgcctccgtcaaacccccggccaatgcagtgagcaccatgtagctcccttgatttaaaaaaaataaaaaataaaaaaaaaaaaaaaaaaaaaaaaacaaaaacaaaacaaaacatgcttcgctgcctatggctggctttgagcagcaacattattgacaaacatacaggttcacacattgaagttggctaaaaaagaaagtgatgctgattgcagtggcatgtgaagaaaaatgtgtgtgtgcttgttcagagaggaactgaaatatataccactataagtcgtatgaggtacatagtattgtact

SEQ ID NO: 263184 - DNA, 365 bp, Homo sapiens
atttttattaaagacaatttgagacagggtttctctgtgttgctctgggatcctcctgcctcagctgggcttatgggatcctcctgcctcagcttcctaaagtgctgggattactggcatgagtgactgtgtccaggccacatgcaacttaaaggaagcacagggaagtgctcagtgtgagggaaaaaaacataacagcagggggcaaggctggaggaaaatgttgaggtgacatcaatgagaacttcagggacccgtgtcctacagagtcggaaagagaagctaaagttctacagtgatgagaatgttatccctgcaaggatggttaccaaggaatatcagaaataaagagcacctgaatgaaa

SEQ ID NO: 263185 - DNA, 514 bp, Homo sapiens
agctttttaggttaaatcgtggcagtagtttttctgaaaacgcggcgcattttgatagctggactttaggtcatccccaggcttcctagcctttcccgcgtcctcaggggttctggttctaaccctggagaccaacaccacatgcgtgtagatggtgaccagcaggagcagggagtctcagacccagtgcagtcagacaggctcccattcccagtagcgaaagggtcccgcagacccaaagcctaaggagccaacaagcagttcgtccatggagcctggcctggatctcccactgtcttcctctccagcattcagccagatgtttgctactgtgttgtcttagtcctggcccaccttatcctttcctttaagaaataaaaatctcaactgggtgcggtggctcacgcctgtaatcccaacactttgggaggccaaggcgggcggatcacctgaggttgggagttcgagaccagcctgacacatggagaaaccccgtctctactaaaaatgcaaa

SEQ ID NO: 263186 - DNA, 1322 bp, Homo sapiens
acagtgcaccgatgccttttattatgcatttttcacttcaggagattgtgcaagatccaaagagaggaaggccaggaatgtgctctctggtaattttgctgtctaaaactaccgaaatgcacatataaatctttaattgtttttataggaattagttaagatttatacagaaatgaatctacctaaaattgctagtcctgtgcttgttgcttactaaaatgtattggattaaaaactattttgcatcttttaaagtttattagcctttgattatacaggttgagtattccttatccaaaatgcttggaaccagaagtgttttggattttataatatttgttaccgattcagcattcctagtccaaaatctgaaatgctccagtgagcatttgagcatcatgtcagtgctcagaaagtttcagattttggagcatttcaagattccagatttgtagattagggatgcttatcctgtagaatatattctagcggagtaagctaattagctacttttcaaaaacttacctggaaaattgtgagttataagtcactttgattaagaagttttataagtttatttaaactgtgtatatttagaagttaagaagttttgtaagtttatttaaactgtgtatatttagaagttgtttagaaattctaggaagttaagtttgtcttttacttgatagccactgtaacttacttagtgtcccttttataaaagaatctttcctgttggattgttttcttttttttctttttttcttttcaagactgggtctagctctgttgcacaggctggagtgcagtgtcgtgatctcggctcgctgcactctccgtgtcccaggctcagctgatcctcccgccttagcctctccaatacctgggactacaggcatgcatgcctggctaattttttgttggtttgtttgttttaatatgtagagatgaggtctcactgtgttgcccaggccggtcttgaactcctaggcacaagcaattgatcctcttgcctcagactcctgaagtgctaggattacaggtctgagtcactgtgcctggcctaaagaatgtttaataggctgggcgtggtgtctcacgcctgtaatcccagcagtttgggagaccaaggtaggcgggtcacctgaggtcaggagtttgagaccagcctggccaacatagtgaaacccatctctactaaaaatacaaaaagtagccgggcgtggtggcacgcacctgtaatcccaactactcaggaggctgaggtaggagaattgcttgaagccgggaggcagaggttgcagtaaaccgagatcactcca

SEQ ID NO: 263187 - DNA, 650 bp, Homo sapiens
gaggacacaggcttctggggtgagttctgggaaaaccaactgctgttccagtgaggctcaaggcaccctgccaagccaggtctgcctggtagtgagggcagaggtccctccaagtctcttctctctagaacggcagcagccacctgctaaatgtaattcaactcagcccatttccactgagcttggattcatattcaagagcttcctgctttcctaaacaaatccttagcttctataccagactagccatttcttagaaatgggatcatcttgatttgcacagcaacctcaataagacctcaatagtccagcctcctcttcccaagtttcaggctttatttacacgacttgggtgaggtatataggatgggcgtggtggctcgcgcctgtgatcccagcactttgggaggccgagatgggtggatcacctgaggtcaggagttcgagaccagcctggccaacatgatgaaaccctatctctacaaaaaatacaaaaatcagctgagggtggtggcatacgcctacagtcccagctactagggaggctgaggcaggacaatcgtttgcacctgggaggcagaggttgcagtgagctgagattgcgccactgcactccagcctgggtgacagagtgagactccgtctcaaaa

SEQ ID NO: 263188 - DNA, 373 bp, Homo sapiens
gtcaaggatagttttaccttaatattatacttaaacataaactgggtattttaatatataaaatggaattctgcttctgaaagacaagctttactttgagccatttttaaactcattatgcaaaggaataacgattttgcaatgatgattccaaaactatgttacagtatatggatacaatggtgagggttataatccatgactcttttagaatacaagtgataatatagagttttgctctgtcacccaggctggaatgcagtggcacaatctcagttcactataacctccacctcctgggctcaagcaattctcctgcctcaacctcctgaatagctgggactacaagtgtgcaccaccatgcccatctaat

SEQ ID NO: 263189 - DNA, 301 bp, Homo sapiens
aaaccctggaagcactgacattatgtaatgactttgaacataaaatggcaatttacaatggtcgtactgtacatctgtttgtccagatacagattgaaaagagggaccttggatatagatgtttacctgagaccttttacctgacctgttgtaacacatttagaaatgctgtaagaaatctttgtgaaactaccccatgactttgaagcttgatactacaccatcaagatccaagtatttctcaaataccccaacgcagcttatgtattcatcaggaagttgagactcttggttatattta

SEQ ID NO: 263190 - DNA, 776 bp, Homo sapiens
tgtagagaaagatgtgattgcttccccttctgccatgatcggaagtctcctgagacatccccagccatgtggaactgaagagaagcactctggaatcctagaagaactacttaaactcctgcagaaggaagtggatcttagcaacataagaatcaactatggtagtacctgtgatgccccctcctgaaaaaagccagcactaatttgaagtgacgaagcacatagggcacagaatttaaggagatacaccctctcaaggtcatatgaatgagcatttccttgaattttttccttaggcacttcagacgattcaccctagtccctgcttgttccagaattgtctttcaaaatggaagatttatcccttagctactgggagtgttgttagaagaaaatctttatctaagcaatccttaggatgggctttggttgaaaaagtggccatccaaaagtcataaccgctaccattggcagcccataacccaaaactactgatcaactaaaaaatgtaaatgcctggcttcctctccccaaatcaggacaattctgttgggccatctcaacatcaaagcttactgtgaggtggctgaaagcttcactgggactgcatcacagctcaacattttcttcatcttaatactgcttccttaccctctgcacatgtgttcatcacaagagaaatttctaattactttccttttcactaacctgtatttcagagtctacttcttggaggaaatcttgtgaaaccaaaaataaataacaaatacattaaa

SEQ ID NO: 263191 - DNA, 271 bp, Homo sapiens
ccaaagtgctgggattacaggtataagccactgcactaagtccagtgaatcattttccagacaacatttactgaatatccgacactgccttccacagacggggaggtttcccaaagaggccgtgctttttgagaagctggcaagataaccctggggtggagggaaggtggcccgcagctgagaccaccaccttactgtccccaaatcctcaccagaggttgctgacacttccctcttccccatcctcatactacttttcaaattagaaaaa

SEQ ID NO: 263192 - DNA, 419 bp, Homo sapiens
taagaaatatataaataccacaatgaaaaggcactttggcttgaaaaacacctgaggtttgcttgtgggaagtaagtgtcattaggttacagcttgggagttatcaggaagtggtggaaggagggctgtctgaagtccaatggaaagttctgacatcaatgtgatgaatgtgattcataacacatgcagtgacctgatgaagctggtagatgtttaaggtgcctgtgtatgtgtgtgcacattttgtgcattcctgcatggctcatttcagccgaatatggttttctgcacttcctagtgtttttctcatgcataagcaaatgcaaaatttatattatgctcagattgtttctggatgtatctgatgcatttgaacaaattcacattttcaaagtaagagttaaagcaaaagtgtcaaa

SEQ ID NO: 263193 - DNA, 565 bp, Homo sapiens
cccctaagctcatttcttactttagaaagctatctgaggtacactacatgagttctcttaaaacccaaggaatctagggagatagataggtcaacccaactgttttctggcctagtacgtgaagcatctcatttatctgctgagaatagcccctcacccgccgatgagtggagagagaacataacgaaagaaagctctcactccaaaggacccacgtgtaagtcactctgcccatgacatgagtagcagcaggagccacttctgaactaaggaggtattctcttatttatgagctaatggcagccttgcactctaaaggctctggaaatggttaacagcctgcaatgagattcagaccctacccacattttccattctccatcccccaacctgtgcccttgttgtcaaactaagaaaacacaaaattgcatgcttgcacctgacactgccaattaagtctaaactagaaattccacagaaacaaaggaggggcagaacttaactgcatttctaagctcccactgtccaatctttttagtgggcatagactaccttatataatgta

SEQ ID NO: 263194 - DNA, 407 bp, Homo sapiens
gatgtgtgtttttgctttattatcaagtatattcctgacaaggagagaaattctgttttgatcagggattagagagaactagaccccatataacatgctctccaaacttcttctcaagaccttaagacctagtaactcaggagagtggacagcaggggtgttctggaatctcttcttacacctagacagccagcaaaacaactcttataaaagtcagtgcaaaagatgtcaatataaccactaactatacacaaatgaattttcatcctatcttgttcttatctggatctcaaaggtgtctgtggccactggccatgaggagaagcatgatggagaggatgttaatgtgggaagagatggcagtcatacctaactgtggattaactatcttactttggcaaattaaa

SEQ ID NO: 263195 - DNA, 636 bp, Homo sapiens
ctcaaacaaactgatattgcaaaaacctttagtatctgctttgaggggcaggcttgcaagtggggagtatgaggtagaagtggtgttgtacttgtgattgggaaggggtggcggaggagagccaggggataccgaggggtggagggaggccagggactctggcagcggctgcataggctgggcgatagagcaagactccatctcataaaaaaaaaaaaaaatcaactcaattcttcaaaagaaagtattttctacagtttacactccctatattatgattgcccatcctcatagaaaatacagaatttaaaaatctggaaatgtaaaagtaaatcaatagcacatgtttataaaacctaagcaaataagtaaattaaataaaaccaatgtctactaagtatgaaaaatggaaaaaatgttctctacattagcaaagaaaatgaaattaaaatgagatatcatctttgatcaatgaaattataattgttttaaaaataagattatagtcattggcacccttccagttcttctccttaccagactcatggtaagattgcacctcactgccctctttcaacttaggtgtagaaacatgacttgctttagccactgaaatgtacacagacgtgatgttac

SEQ ID NO: 263196 - DNA, 383 bp, Homo sapiens
gaacaaatactgagctgattcattattagcacatttgcactacataagtgttaaagaaaatttctttagtaaaagaaatataataccagaaggaaaatttgatctataaaaaaagaaattaagagtcccagaaatatataaaaattatgtaaaatttttttgttttttctccttaaaagataattgattatttaaagcaaaaacaataaagtgttataggatttgtggcacatgttaaatgtatgcatttgaagtaaaatgtatgataacggtagtgcaaagacagaagagaaaaactgacttctcctgctgtacattctttatactctacatagagctgtgataagttaaagatgtgtattgtaaactctagatgaaataaa

SEQ ID NO: 263197 - DNA, 383 bp, Homo sapiens
gaaatcatttttgtgtgtcttcactagtattccttatgaaatgaaataaaacagaaaatataatgcagtgcatatattaagtgaaggtattgttttataacaccatttcaattatatatatgcacacacacacgtgggtatgtatgtaggtgtgtgtactgtgtgtcacagtataaaacattttctttacagtgggttatagtaaaattttctgaaaacactctttcatgatacatacatagaagcagaatttctgaatcctagactatgtacattttcagccttacttgctaatgacaacctagttgatgaataaatttatgcttctatcaggatgtcactaaattcctttttcttcatagctttaacatttgatattctct

SEQ ID NO: 263198 - DNA, 519 bp, Homo sapiens
atcctgcccaacatggtgaaaccccgtctctactaaaatacaaaaattagccaggcgtggtggcgcgcgcctgtggtcccagctactcaaaagaatttaagctctgataagtgctgtaacaggatgaacctgaaaatacactcagtgaaatttgacagaaaaggacaaatactgtgattctacttacatgaggcacttaaggataggcaaatttatagagacagacagtagaagttaccaggggctggggaaaacagggcatgggatgttattgcttaatggttacaagtttctttctgttttgggtgatgaaaaagttttggaaatggtagtggttgcacaatattgtaaatataattaataatgtcacttaattgtacatttataaatggtagattctatgttacatatattttacataaaaaaagtattagatctaaaactattgaattgtacactctaaaagatgaattatttgatatgtgaattctatcttaataaaactatttaagaaaccaa

SEQ ID NO: 263199 - DNA, 476 bp, Homo sapiens
agtctaaggtatgtctttatcagcagcgttaaaatggactaatacatttgcctaagcggaaactcgggttctactttttatacagagcttaatagtttataatgaacattatagtagtagttgtgcatcaaaacctataaggtgggcaaaacaggtaatacttctcccattttacaggttaaaaaatggaggcaacagctgggtacagtggctcactcctgtaattccagcactttaggaggccaaggtaggcagatcacttgagaaaaagagttcgagaccagcctgggcaacatagtgagaccctctctctcaaaaaaaatagccaagtgtgatgatggacacctgtaaccccaactacttcagagactgaggcaggaggatcacttgagcctaggaggtcaaggctgcagtgagctgtgattgggccactgcactccagcctgggtgacacagagagacctctctaaaaaata

SEQ ID NO: 263200 - DNA, 705 bp, Homo sapiens
ataaccttttgattttcgagtagttttatttattattgctatttcttctgtaggtaagtgactcccatgcagtgattgccaaatgggctttcttcccaggtcctctgaaagaatctggaggaaatgatgatgctcaggagacaattcatgatcactcggaatttctgacaaccatggcaagtatgatagcaacaaagagataagctttaagcaatttctaaatattgtacatttccgtttatttagattatcatcacaatggtttgttttgttgtttgtttttgtttttttgagatagagtctcgctctgtcacccaggctggagtgcagtggtgcgatcttggctcactgcaacctctgcctcctgggctcaagtgattctcatacctcagcctcccgagtagctgggattacaggtgtgtgccactgcacctggctaatttttgtaattttagtagagatggggtttctccatgttggccaggctggtcacgaactcctggcctcaagtgatccacccgcttcagcctcccaaagtgttgggattacaagcgtgagccaccgcgcccggcccaacacaatgggatattataaagtcaatttttttatggggttgagaaagataacttttaaaaataatgggtattctggttgtacacagagataaagaatacgtatgatgatcttgaaaatgccttgcctatc

SEQ ID NO: 263201 - DNA, 492 bp, Homo sapiens
ttaccacaatcagtaggctacttccaggtgggtaaccttgaccatgtgaacataaaaaaatatggatgactttttacatcaaaatagatgcctttagaatcttcattcatggatctagtcaatccatgaatcctactaactatgggtttctttactttgagttaaaacacattaaaaaatatttatctagtttgctaaaatactaaaactaaagccattttggtctgatattaatatactccagctctcttatggttgttgttcatggtatatcattttctattcttttacgttcaatctgtatctttgaatctaaactctgtctcctgtagacagcatatagttggatcacgtttttaacaatctaacctgatcatctgtcttttgattttttgtataatccattcaccccaacctttttttttttttttttttttttttttgagatgatgtctccatctgtcactcaggctgtaattcagtggcatattc

SEQ ID NO: 263202 - DNA, 122 bp, Homo sapiens
attctttctattataccacactctccacctctctgattccatgcaggcttaaagctcttccctttttcattgtattctttttgtttgtttgtttttttgagacagagtctcactctgttgcc

SEQ ID NO: 263203 - DNA, 235 bp, Homo sapiens
gcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgc

SEQ ID NO: 263204 - DNA, 335 bp, Homo sapiens
gttaccaccattcctggtattggtcccagttcttctaagaatatttttgatgcaagagctgttttatcttgaatcctacatagcttattttccatttttccattcaaataaaacaacaagagaacaatagagtgaagaaaaaggatgtttaagcctaaatccaagactgaggtacaagaccaagaaaagtggggcagaagatggaaaagaacaagtgaagaatcttggaaacaattcaaaggcacgttggattctttgcttgtaataagaagtgcaagttggtgttacttcttaagatctaatgttaaaatttcttgaatctgatctttatcgta

SEQ ID NO: 263205 - DNA, 249 bp, Homo sapiens
cacatgtcccatctacgcacccacgtcccgtccatgcaccccatccactcacctgtatcctatcacctgcatcccatcactcccatgtcccatctacacacccgcgtcccatctacttactcttgtcccatcatagacacctacatcccatttacacacgcatgtcccatcatacacacccctgtcccatctacacacccgcgtcccatcctcgcatccccatcccgtcctcacactcccgtcccatcc

SEQ ID NO: 263206 - DNA, 409 bp, Homo sapiens
ttttattttgagagtgtacacattgacctcttaaaggatggctataacagctgctttaaagtctcatcatttcaatatccaatttgcttcgaagttgttgtctcttgattgtttcattccttaataattgttcaattgtttctggttttttaaagtatattgggtgattttctattttgtcttgcacatatgcatttcctctgtttgcaatacagaaaagtttcaaaaaggcaagctttggacattggagggaagagacactagtgctacattgtaatccactgggtggttcaaatgccagaagggtttgtcccactaacatttttctacttggagcttgtgcctggaggtttctctctgtctctaatgaggtaatgttataaatatttaatatcataccatacattca

SEQ ID NO: 263207 - DNA, 336 bp, Homo sapiens
atcccatccctgctaacatcatcccagaccagatgcgtggattttcataagggcagtttcttggaaacaaaatgtccaagtcaagggagggtcttgaagagtaggaatgtcaacccagtaatcggatggtaggtgttgtcaaatcacacccagtaggcagctgcctacatacgggtaactggaaaagagatgtgccttggagagttaattgctggctatccccaagaggcttcttgtcttcccaagccaagtaagagcctgcctctccccagcttcattaatgtgaatggtggcagacacctctagctatagagctctggtttcctcctaagtcca

SEQ ID NO: 263208 - DNA, 224 bp, Homo sapiens
gggaggcagaggctgcagtgagctgagatcttaccactgcactccagcctgggtgacagagtgagaatctgtcttaaaaaaaacccaaaaaacacctcccaaatggcttcccatctgattagaataaaagcccatgtctgtttatggcccacgctctcttcccctgcctctctgacctcctctgcatccactccctcctgctcactcccatctgtgctgttctg

SEQ ID NO: 263209 - DNA, 617 bp, Homo sapiens
atttcgtccaaatggcacaacgcaggcttgtcatgaggccattaataactcaccttttcacaggctcttcttggtttcctggttcaggaatcagttcttatctagacagacactgatgtctggatttactggtgtgaggacggacaaatgggctttgtctggggcaggccacataaatgtgatttattttcactaagtcaagaactgagaggctgaaggcaactcttgacaataactaagctgaagaaattgagagtaaaatttcttcccttttgtctctctcccactcaatggtcaaagtcccaggaaaggctgaaacggtgtttactttcccccacttaggctgacccttcgcattccgaccagctgaaaggatggaactggctggtcagtttcactttccactttcaggaagggtaactttctgttctcatccctcaccgtgaaaggctgcatctggctttgtggcttggtcaaggctgggtggaggtgggggtgtgatgcttcttggcgaagggcttaaagaaatatgaaacaagatggcattccaaattctgcataaatataggccaaaattaaaactcctttaacccaggagttgctggccttagtggtcg

SEQ ID NO: 263210 - DNA, 686 bp, Homo sapiens
tgctgggattacaggcgtgagccaccgcacctggccctaagttgtctggtttctatttatggacataatgataaaagaaatgtggctgagtcctttttatggctacgaaacagtctgtaatatatcttttcttcaaatgtgaagttgagtcgactgattcacttaataggatgtgtgttttgggatgtttttaggcactctttgttttgaaacattccctcatctgcctacttattttctctccacaccattctcccgttaaccagctgcagaggctagcagagctcagcatagggaataaagtttgatgtctagtcaaagctccaactcataactttggtctccttgacatggtgttaaaacagacccagacagcctaattaagggtcatagtttaaacccaaggctaagttagccacaagctacacaatctgcttatttcattttataagacacaaagagccaagaactttcatgtatcttgctcttcctgatggttttccctccaggccctaaaagcctgttgatagtcttctaatgaggtccctatctctcccttctccctccttcctctttggtggcgctgatgcttctgtggtcaaagttcttggacagcctacattttgggggctatggaaaatgaatatgagaaaagaaaaaataaaggctattcattccttcattca

SEQ ID NO: 263211 - DNA, 969 bp, Homo sapiens
cgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgaaaaaaaa

SEQ ID NO: 263212 - DNA, 896 bp, Homo sapiens
cgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttacaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgaaaaaaaa

SEQ ID NO: 263213 - DNA, 604 bp, Homo sapiens
tgtagcttactatatctgtgaccttaggaaattcactcaacctccctgtgcctcagtttcctcatatgtaaaatgagaatgaggataacacctggtcttcctgtttcccaaagttactgagaaaatttgttgaatttaaaactgacttgctggggggcagtacataaatgttattgttaattaacagtttttatacctactatactaggctatatttgctcatgggctgcctccccttagaacagacctcagagtaactagtccttgagggaaccgacccttatctagctagtctaccgacgactgcagtcctggtttctttttctagactagctggcggcctggctgcaatgcctcgccagcccagtgatctctcagacctgtgggtgtgcccactgaatcttgcccatacatctctgtgtttcttctgatgcgtgtagtcagtcatgactctgggctctaagaaccttgagaaggacattcatcctgttccagagcttttggacaggagagaatgactcctgtacaaaaatgtactgcaaaatctgtccccaagggcggcaagtatttttctcagcagacgtttttttctgtttctctttta

SEQ ID NO: 263214 - DNA, 435 bp, Homo sapiens
attttgtagatgaggagattgaagcctggagaggtaaagtgactcagccaaggtctcacatttgctaagtgccagtactggatgtagattccaggtttgtgtgacagcaagcccacgctcctcagccactagttttgtgtaaaattgttgttctctttccccgtctcctgcttaaggaaagatatattgtttcctggaaaaacaaaaatgttagcatatagtttgcaaactacaacttattatttggttatgcaggtgtgtgtgtgttgtataaacattatatatatttcacttggatatattccacttgataggaactgctttgtttttgaatgaatatatgagaaaggaaaatgcctgggtttttgtttgttaccccaatgtagcaacattatgaaaggtaaaatgctctttctttaacagcagcagcaaaaa

SEQ ID NO: 263215 - DNA, 510 bp, Homo sapiens
actctcaaaagtgtcccagtttggactgataaatgttatggtcactgtggttatagaagaaaggtatctccttcttgctttgactctgaatggctagattctataaactgaagttctattttgtattttgttttataagctactatttattgagtacctattaccaggtattcttctaagcacctaacacacattttcttaatttaatcctcataatcctctctgaagaaggtgttatctctgttttatagatgaggaatttatggcccagagaagctaagtaacttattcaaggtcacagctagtaatgctgaagctagaatttgaacaaagatctttctgactccaaatttactacattttattgtatatgtctttataaatcacaaaaatgtgtacaatctctatgtcataaatttaatgtgtagtaaggatttatctatctctgagtcttccataaaccaagttaaggcttattgttaggctctatctgtcctaattctcaggttt

SEQ ID NO: 263216 - DNA, 1283 bp, Homo sapiens
gaataaatacagagtgtttttatgttctttaaaaaattatcttgcaggttctgcatcactctttcttctctcatgctcttgacccagagggtcacgtccctctctctggacatttgtgaggggaaagtgaaggcagcatctggaggcttcaggagcaggagctctttgtctgagcatgtgtgtaaggcactgccctatttcagctacttgctctttttccctgctctcctgggaggctctctgtgctccttccagcgatttcaggctcgtgttcaagggtccagtgctttgcatcccagacactctttctgggctctgagctggaggggtctgcagattcttggactagaatgcctaaacgtggcagtgagcagggtggtggatgcaggagcgggactgactgattgccagcaattcgagtgcatctatgtcgtgtggaccacagctgggcttttcaagctcacctactactcccactggatcctggacgactccctcctccacgcagcgggctttgggcctgagcttggtcagagccctggagaggagggatatgtccccgatgcagacatctggaccctggaaagaacccacaggatatctgtgttctcaagaaagtggaaccaaagcacagctcgatggctccgacggcttgtattccagcacagcagggcttggccgttgttgcagacatttgccttctctgcctggtggcatggactccatccaggacaggtgtttggtttcgtttgctgggccgtgatggtggaagctgactacctgattcactcctttgccaatgagtttatcagatcctggccgatgaggctgttctatagaaccctcacctgggcccacacccagttgatcattgcctacatcatgctggctgtggaggtcaggagtctctcctctctctggttgctctgtaattcgtacaacagtgtctttcccatggtgtactgtattctgcttttgctattggcgaagagaaagcacaaatgtaactgacatctttccctggctttcaccttaaacacccaggaaacattttagaaagtgccagatgacgcatcgataatgcatacatttgaacttttccataataaaattttttctaaagttttggatggatatacccagtgacttgcagtaggaatttgtgtatctactttagcaagctattctgctggtactgaggatacaaaaaggaaaaagatgtggtttcttcccttaaggtttacagtctagatgtggaagcaaagattaagtaaagtgataca

SEQ ID NO: 263217 - DNA, 403 bp, Homo sapiens
ataacatacatatattgtgtatttttaaattttataatctgcctttaaataatattttaacacttcacacagtctaaggaaaggcaggaatgaaaacacaaatctgtgactttttttcaaagcaccaattttcttctgagagcaggacaccatttagctgacttggtggcccatgacattaggataaattaaatgtcagggttcaaaacgttgatttataattctgatctgaatatgtgagggagatattcatgatggcattgcatgcctgagtttggagaacacaaatctgtatttgtaccaatgtgtaaagctgtgtggtgttctccagcagcactcagcagcctggaaaggaagtggagaaatatgtgaggtgaggttgaggaggacggacggatatggc

SEQ ID NO: 263218 - DNA, 508 bp, Homo sapiens
tctttgaactacttagttaaagaagaagaaaagaaaaccaaggaaacaaatacctatttttggttatactcagaaacatttttttaaatagcagaagaaaaactttttttaaagaaaaaagataagtgtattccttaagaatgagaccataaatatccctgacccccaaccctctagggacacctccaccctgaactttagttaattagctgaagaagatagaatttgtggtgttttcctagaaaactagagctgtgtccgcgtggacttggggaagggtagtcccttcccttctcccaaatgatgtgtggatgcccagggctccacaaagctccaaggcagtgccccctctgttcccaaagcagcttctctcgggagcctccctctcccttgggaagggtgcggctggggcaggagggggctggggggccacctggccttacttgggttttgtcacactctgctcattttgactgaataaaagtcctgttgccaaagtgaaaaaaaa

SEQ ID NO: 263219 - DNA, 370 bp, Homo sapiens
caccagtataaatattcagtagtgatgctggaaaattggtaatatgcccattgatgccaaatcactcgctatgtttcctttcaagtgagatctgttgtggatatggttaaaagaaactatgatttttcttccttgagagcagatgagctgtaagaaattgagaataacaaccgtcctgacagctttcatgtactcaatcttgcctatattgcttttaattctggcttaagtcctgcgggctttccctcccacccccttgcctgatgcgtattgtaaagaacacatttatatgtacattagttagtttaagaggctttttgtgttcaaaggaagaagttagtcatcaccagaaaagctttgttgcaaaaca

SEQ ID NO: 263220 - DNA, 338 bp, Homo sapiens
tgagacggagtctcgctttgttgcccaggctggagtgcagtggtacgacctcggctcactgcaagctccaccttccaggttcatgccattctcctgcctcacactcccgtgtagctgggactacaggcacccaccaccacgcccggctaattttttatatttttagtagagatggggtttcacagtagccaggatggtctcgatctcctgacctcatgatccacccgcctcagtactgggatttcaggcatgagcctccgtgcccggccctaagtttatcttttaacccttgtacctttttggggagtttttaaattataatttttaacttcctggga

SEQ ID NO: 263221 - DNA, 1112 bp, Homo sapiens
agcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtg

SEQ ID NO: 263222 - DNA, 701 bp, Homo sapiens
gggatgaagttttccaaaaggcctgtgaagttttagttaccaggggtttgagaaaagggaatctagctgactaaaaagttcttatgggagaacaatatccaaaagagaacggagaagcttaaaaaaagtgcagtctgaatgtcagcttttaatgaagctgatttctaaccatttctaaccacagacctttctttttgaaacaatcctttacaatttcttattattagatttcaatggggacaaacagcacatattctgggtttttaattttttaaaaaactaaaggcatctatcaggtgattctgaatgcaaatcaataagccttttatgacttaaccaagaatgtatgattcatctctaaagaggtgcaaagaaacagtcctcccaagacccggagccacccgctaagacagttagaagaaaaaagaaaaaaaataaaaaagaaaaaaaatttttgggcggcacttgcccttgcaaaaaggcttttatataaaccattctcgtttgggcgggggggccccatattgggttagggaaaaatgtttggtaacattaggcttgtccctaaagggaaaatctgggtcgaaggaatatggtggtcgtgggatttttcacacagtataaaatactcgggggggacacgaaggtgtttttgtgaaaaatttcagaatgtgaagtttgggggggaaataggggagtta

SEQ ID NO: 263223 - DNA, 174 bp, Homo sapiens
ggagaccggacccggttaccaccacctccccgcaatttctagtctctaaattatgctgtccccgaaaacaaagaaagtgaccaagaaataatgtgaaaatgttaccaagagagtttactattgaaagaagtctagccatcaaataaatgtcttttactaaacgatgaataaatc

SEQ ID NO: 263224 - DNA, 130 bp, Homo sapiens
ctcagaacctcttaaaagataaaatggtcattgtagaatgtatctcagatgacctatcgtgcattttagagtgcatactggattaaatatgtttaaaactccttttatcatctttaaaaactcaagctgg

SEQ ID NO: 263225 - DNA, 338 bp, Homo sapiens
gatctttccatcccagcctcacaaagtgctaggactacaggtttgagccatcgtgcctggccatttatgtattatctatggttatgttggcactataataacaggatgattagttgtgacaaaggacatatggtttacagagtctaaaatatttaccatctactcctttacagaaaaagttagccagcccctgacataaaacatgtagaatttattaggctttgttgttaaagatcgaattctctaagtttcatgaacaggctttggtagaagtgaggtagggggtaaatcctgtaacatagtaacaattttttgtgtatgaaaatgtgcatttgaaa

SEQ ID NO: 263226 - DNA, 471 bp, Homo sapiens
cagcggagatgttccttggctgttcctgacacccccttagcacctcccagcgtgagccaaacactctgggactttactgccaccttctggaaagctcataaatctggtgtctgctgcactggaattgtgaattgtgccctgttggaaaggcttgtggacaacctacataaccatccatacactttgagtccatagagaacaccaagaaatgttgggtcaccagagctttgaaagtgggtgtatatagtcgaagaggaagctgaagataacccggtggcttctcagttctccacagctggccttcctagcagcagcttgttgacagcaccccacccctgttgatgctctctacttcaggtgactgtgacctgacatcagtgggagaagacatttgaaaataaagctatttactctcatccccactgccctagggaaggcatgagccataaaagtgtagcttaaaaaggaagg

SEQ ID NO: 263227 - DNA, 461 bp, Homo sapiens
gaaggacatttgagtaaatacgctcccttgctcctttcttgccttttgttcattttttgtacatccacaatctatgaggtatgttacctactgaaatttactttcttttccaactgtggttcaacaactgactttcttctctcatactttccaacccattccattctgaataagttaagagttttcttaccttcagctcttctcaccttccaatactaagtgaatacagcctgcctcccccttcatttctgattacaatattattctcatcatcctaggactttgtacctaatcaccagttgcttctcctaagtttattttacagctgataagccaacttggaaaatgagcccactctccctcagatacattctcttccgctgtttgaaacgtttttcattgaaacaatttggtgatattgtatcaaaataataaagtattaagctactggaaaaacatgg

SEQ ID NO: 263228 - DNA, 234 bp, Homo sapiens
tgtagtttcacctgccacctaaacactgatgaataccatggctgcaacttcagcctcaacctctctcctgagcttcatgcccatattccagctgccaactcactatctctccttgaatccttgcagagcacctccagactcaacatattcaatactgacatcattatattcttccaagcctgcaacttaaatgatccatcagcaccatctaaccacacaagcagaaacctagtt

SEQ ID NO: 263229 - DNA, 306 bp, Homo sapiens
ctttgagtggagtatccatataatttatttggaattctgcaaagaagatttggaccaaaattatttcaatagattataaacgtcattaattccatggactccctcaagtcaaggaccttaattgtcttctttcattctggtacttagaacgcccagaataaattacaagctagattaaaaggaagaaacaaacaccaaaatgaccatcgaagacattttcaatgaacattctctgaagctaaaaattatattaacataaaacactttggcagctctgacaaataaaatacgataaaccaatcttct

SEQ ID NO: 263230 - DNA, 628 bp, Homo sapiens
acctgcacaaagggacacagcttttaagcaatgcaatgtgtgactctggagcctgcacttttacttaactgatggaatatgatctgtctcagagacagagagaggaacagactgtgtcaacttagagaaaccaaatatactgatctccaaagggacagcttcttaagctgtgaccttaaaaaattgtgaccatacacaattttcagccaatgtgatggtttccatcacctcccacctaagagatgacaccattaatgtatacaaattgttgtagaagcttagagaaagaaccaactaatggggaagttggagaaaatgtctcagcagcggggatattcgagctgagttttgaaggataaagagcagtttccaaatgaggaagaagtgggcaaggacaagctaagtaaagctgcctgaactgttgacggccaccactggctctagaaaagcccctgctacttccttctgtctacttgaaagtgcaacataagatgttttcagaacaaacaggagtatgaatgggaagactgtggttcagtatttcccaaagtgtttgccatggaactagttctgtgagatgcttcattgaaaagagattctgaataaaataaaacattcatttaacaaa

SEQ ID NO: 263231 - DNA, 457 bp, Homo sapiens
cagccactgactgggtcagaatgtgggaagcatggccttggaacaaacatggtgatggatttcagagagcagcagctggagccatcagtcagttactgtttgtgggcagagatctgagaggaacattctcatggacacctgtggcgactttgtaatgtgtcaactcaagctagtctaaagtacatttctcaagactcccttacccacaattctggttaggtgagacacaagagttcttttcatgcaagatttggaaagcaggatgtgagggcaatccggctgcgacatctgtcaccccactaatcaccagagttgatttcagctgatctagctggctagattggtattaacttcctccctcactgctctgtgtgcatctctcccaaagctgtgtgcttggtcaaagaggacgaccctccctaatagaggaggaccactctttggtcaagaatatacg

SEQ ID NO: 263232 - DNA, 418 bp, Homo sapiens
gccatctccactgtccatcttcagaactttttcattgtcccaattaaattgcagacttttaaaggaggaaaaaaagtttattgtgtgtgtcctgtctagcgcactcttccaggttagttgtaccttttattgtctttgagccagtttacagctctgtaaagttgtgcagtaatcatgagaatggatttttgtccacgttcctgtaagttaattgtgtccggtggaatgcaattggatattgccctggggacaaacctgttttgcgtctatttgtaaattcacagcagcattccgtgtttgcctgcaagattccgtgcttctacgaatttgcctttgaaccgcccatggcatctgtctgctttgttccctctttgattaatgtgttaaataaaatctttgacacatgttcattttctac

SEQ ID NO: 263233 - DNA, 743 bp, Homo sapiens
gatttaaagagaattacagacagacaaggctgaacattggctgtcatccaacaaagctcttataagatgggaatcactgcccggttcttgagctccgacctggagggaagaggagtctggaagacttggcacaggcctgagtgcttcattgtctttctggttccaagtcctcctcagctcactaggaaggaggtggggtgggggcaggtaggccactctgcataagtgcacacatctacactggctagtctacttcacaattcccccacaggttatccttatctctacctggttccagttccagattggagggatatagaataccatccccacccctcaccttgcttgctctggcctggaaaactgtcattcctttaccaccagctggcatctgccatatgcttcaaggaactgaataaagaggaaggggaaagaagaaactagagaaactggaatgcttcctatctgacccccaagtacagggactgcctctttccgtaacggcacagaacgtctccatccctttgacctccacctccccagagatgcccgaggaggacagccttgtttctgtgatctgttgttgagaactgctgctgagaattcttccttcagcaccgccttaggcaccattggtttttcactaggtccgctgtagaaaacagccaggaattacttagttgactaccacctgaggtgctgtttggtgttggtaataaagaataaaggtggaaatgaaacaa

SEQ ID NO: 263234 - DNA, 595 bp, Homo sapiens
gaaaaaacctttcttttattctaacacaattaagtaaaatatatttaattggacttttcaatcctctttggctacatcattttctactaacagaacctgaagaagtgctcacaggtattgggaggagggggatgaggttacaaagtacaggtagttcctgatgcagctccctcctcactgtcctctcttccttgcatctctgtgtggccccatccttagcattactgaggtttttaggaagtggaaagctggctgtggttgttggatttattcactattcatattggttttgttttatttgcagtaagccatatcaaaccaagatgtgaagggtcagtaccacagagagtcgccacaggacatttgactggagacaatgaagagccagatcttaatcaagtccagtgtgtcttttcaaaattaaagaatgtcaaataataaaaataacaggcaagacattcatagtgtctatatgtatcagctctgtgctatgcattttatctgtggacattatcctacttaatcctcctccttcttaataggtagctattattttttatcttcattttacagatggagctgagaactcagaccc

SEQ ID NO: 263235 - DNA, 589 bp, Homo sapiens
gaactgtggaaccagttggatggatttgattctaggggagatgtgaaagttatcatggccgcaaaccaaacagaaatttggatccagcacttagcagaccaggctgcactgacaggaagatcgggattcccctccctaatgaaaatactaagaagagcatctttcagatgcatacaagcatgatgacactggccgatgatgtaaacctggacgacttgataatgactaaagatgacctctttggtgctgacatcaaggcaatctgcacagaagcttgcctgatggccttaagagagccacagaatgaagatgtagaagcttcagacttgaccaaagtttatacagcctgcacctgggagtccaccgccatacactccctccactgtaccctctctctgcacaaagtaagccatatcaaaccaagatgtgaagggtcagtaccacagagagtcgccacaggacatttgactggagacaatgaagagccagatcttaatcaagtccagtgtgtcttttcaaaattaaagaatgtcaaataaataggatgcggccaatcccctcccctctcataccccgcgactcgcaagac

SEQ ID NO: 263236 - DNA, 696 bp, Homo sapiens
gaactgtggaaccagttggatggatttgattctaggggagatgtgaaagttatcatggccgcaaaccaaacagaaatttggatccagcacttagcagaccaggctgcactgacaggaagatcgggattcccctccctaatgaaaatactaagaagagcatctttcagatgcatacaagcatgatgacactggccgatgatgtaaacctggacgacttgataatgactaaagatgacctctttggtgctgacatcaaggcaatctgcacagaagcttgcctgatggccttaagagagccacagaatgaagatgtagaagcttcagacttgaccaaagtttatacagcctgcacctgggagtccaccgccatacactccctccactgtaccctctctctgcacaaagtaagccatatcaaaccaagatgtgaagggtcagtaccacagagagtcgccacaggacatttgactggagacaatgaagagccagatcttaatcaagtccagtgtgtcttttcaaaattaaagaatgtcaaataataaaaataacaggcaagacattcatagtgtctatatgtatcagctctgtgctatgcattttatctgtggacattatcctacttaatcctcctccttcttaataggtagctattattttttatcttcattttacagatggagctgagaactcagaccc

SEQ ID NO: 263237 - DNA, 357 bp, Homo sapiens
ctagtattcgccccgtgtccctggggcccagcacagagctggcacaaaagagatgtcactaagtggccaagggaatccaggaaaggccagagaaggcacattggtataggagcaggcgggcagaggtgtagggtggacttggagggggaattgaaatcaagaaaaggaaatagccctagctgctgcctcagcctccttgaggggagctgatacttggagttggttgccgttaggttaccctcatttggagtagtactgatgagtgctcgaccgaaacctgggtctactctggtggcgattttgagttcaagcagtgctgccccctactgggggttgctaaaagcactgccatttcag

SEQ ID NO: 263238 - DNA, 498 bp, Homo sapiens
cagattttgagtcatgccaggggctccggtgaaaatgtcatgggaagccagccctccgcgtctaacatttcagcttgagggtgaccaggagctctggggtggccctagacctgggaatggactcccaggcgcagtggcaggcatttctcttgctttttctttatgattgacctgggctggccatgtccccgtcaatgcagctggttctcaaaggccccactcttccccgcggctccatttaccaccaacgcgcttgtcccgtggcacttagagggagacctgctcctcctgagaatccaggaaggaactgaagagacgacgttgctttctgatctttctcaggccagaggaagtttgtgggccaagtgatattcctaattcaaactttattatgtaattatagtacaaaacatattatttttctctttatttttcctctctcagttaatggtaaattgtattgcataaataaattacacatgctgtaattcataaaaa

SEQ ID NO: 263239 - DNA, 1251 bp, Homo sapiens
tctcccaagaacatctggaagctggggaaaacatcagagcaagtgaagaatgttcaaatatacagggaccatccagagacatgtggcctgcacgttgatgagcaatgtgaactgaattactgttgtatctggaggaattccataaaagagagtaatcagtctatttggatcccaactgccttttcctgtccccaaagggcgggaactagtgtgggtggaaaaacccaatgcatcccaaggcagtcctgccttctaaagcgcccgccaggacaggctcctggtgggttgtaaggagaacggcaggaagaagtgctcccaggaagctgcctagccaccgccaccaccacagggttccatccaactgacttatggcatcaggagctttgaattgtctcatctccaagactctgaaggtccttacaacactagcaatccccttcatgccttaggggatctctacatgatgtcctgctcagatgatggaaagccagcccccttcctcttgcaaactggcttcttgcacagtcacctggccttagactagaaccatggctctcaaatttcagggaaagtatgatcaagcagttcatcagggaagcacaaatgccacatggacagggcaattctttttcaagaagacccacagacttctcctgcctaggctctgaagaagccacaaaaatctgtccttccactaggctttcaggagagatgagccgtctccatttccatcagtcactcagctcttccccaacaccacagacaactggccgccttggaggctcttccaagtttcctgtagcagactctttagttgttataatgttccagaaactgaagtgggaatggaagctatcaagttttctgtactccaaaaattgtctccagcacattccctgagaaagtgttgcatccttgccctgaacaccttccaacagaatgactaaggaatactcaatgctagaccattccagcctgttcacccaccaagaggtggaacttgtctgaagctacaggaccacaattgaccataccctcccctccttctttgctttatctttttggaacatattctgtttattattaacatttttaaactatgagacttaaagataatctgttctaagcccctaatcttgtacatgactaaaaaaaatcacaaggacaaatagaatgcatgcacaccatcactctcctatcctctacccacagcagagatcactaatcaattaaagcaatcttttctactgc

SEQ ID NO: 263240 - DNA, 780 bp, Homo sapiens
tctcccaagaacatctggaagctggggaaaacatcagagcaagtgaagaatgttcaaatatacagggaccatccagagacatgtggcctgcacgttgatgagcaatgtgaactgaattactgttgtatctggaggaattccataaaagagagtaatcagtctatttggatcccaactgccttttcctgtccccaaagggcgggaactagtgtgggtggaaaaacccaatgcatcccaaggcagtcctgccttctaaagcgcccgccaggacaggctcctggtgggttgtaaggagaacggcaggaagaagtgctcccaggaagctgcctagccaccgccaccaccacagggttccatccaactgcccacagttttgctgaactaggaattgtcctgagaactttcttccacaatggctcagcagatctccattttaaaccggcagtctgcaaactcagccctgaggacacagccagcccgcttccaggcatctcctgcgagctgctcccaggaaagaacagcaaagcaacctggtccagtgtagacatgctgttcaaatcatctgtggttgaatgactatttttttaatttaatcttttgcagacatttttggtaaaacattatataaatgaattactagaaaaaaagaaatacaaaagtaaaaacatatgaaatataagccccaatcttttgttattagattcaatacacatagaaataaattttaatacatacaatcaaaacaaacagcatgggataaaataaaagaatcccaaaacc

SEQ ID NO: 263241 - DNA, 148 bp, Homo sapiens
cctgcctcagcttacagagtagctgagatgtgcaccacaacacctggctggtttttgtgtttttagtagagatggggtcccctggcctcatgtgatcctcctgcctcggccaccaaaagtgctgggatttcaggcctgagccacaatg

SEQ ID NO: 263242 - DNA, 454 bp, Homo sapiens
gaagtctcaatggccaggctctgtgtgatctgccagagggtgtcagacccctggacacactcagatccgtgtttttcggccgaggccctgccaagaaatggctgcccacagcaaaggaagtcccccaggaagctcagctgttgatcacctgagtctcacatttatccgcatccaccaaggagtcacagccagagaactctttgcagatcccatgaaggggcccctccttccagagcgggacagggtctgagcatgtcttggctatgtactcacaataaagcaggggcagccaccctggatcctgaggcccatggatggaagctggcttatagcacacactgagaggaaacaaaattgaaccttctggaggtggaggtcttcccggaggatctcaagtgacacagtggtccagaggtgatccatgcacaaatgcaacaccgagggtaaatcccat

SEQ ID NO: 263243 - DNA, 268 bp, Homo sapiens
gtttccatctttatagtggctgcttatctaactgtgagtgatggctgtcactattcactgtgggacaggtatcaaatgtcagcaatctcttctactgccaatttgctgtttgtttttctcaactcttctccatgttgaatcctggaagttattgaaacaatccttgatcattgcttttagtctctagttgttgttaggcaaaaggatttgcggctcctcatcagaatagcaagtgaataaagagcatggattatggaatcagaccaga

SEQ ID NO: 263244 - DNA, 1578 bp, Homo sapiens
aaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagcaggcttggtgcatttgacacttcatgatatcagccaaagtggaactaaaaacagctcctggaagaggactatgacatcatcaggttgggagtctccagggacagcggaccctttggaaaaggactagaaagtgtgaaatctattagtcttcgatatgaaattctctgtctctgtaaaagcatttcatatttacaagacacaggcctactcctagggcagcaaaaagtggcaacaggcaagcagagggaaaagagatcatgaggcatttcagagtgcactgtcttttcatatatttctcaatgccgtatgtttggttttattttggccaagcataacaatctgctcaagaaaaaaaaatctggagaaaacaaaggtgcctttgccaatgttatgtttctttttgacaagccctgagatttctgaggggaattcacataaatgggatcaggtcattcatttacgttgtgtgcaaatatgatttaaagatacaacctttgcagagagcatgctttcctaagggtaggcacgtggaggactaagggtaaagcattcttcaagatcagttaatcaagaaaggtgctctttgcattctgaaatgcccttgttgcaaatattggttatattgattaaatttacacttaatggaaacaacctttaacttacagatgaacaaacccacaaaagcaaaaaatcaaaagccctacctatgatttcatattttctgtgtaactggattaaaggattcctgcttgcttttgggcataaatgataatggaatatttccaggtattgtttaaaatgagggcccatctacaaattcttagcaatactttggataattctaaaattcagctggacattgtctaattgttttttatatacatctttgctagaatttcaaattttaagtatgtgaatttagttaattagctgtgctgatcaattcaaaaacattactttcctaaattttagactatgaaggtcataaattcaacaaatatatctacacatacaattatagattgtttttcattataatgtcttcatcttaacagaattgtctttgtgattgtttttagaaaactgagagttttaattcataattacttgatcaaaaaattgtgggaacaatccagcattaattgtatgtgattgtttttatgtacataaggagtcttaagcttggtgccttgaagtcttttgtacttagtcccatgtttaaaattactactttatatctaaagcatttatgtttttcaattcaatttacatgatgctaattatggcaattataacaaatattaaagat

SEQ ID NO: 263245 - DNA, 1700 bp, Homo sapiens
aaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacagcaggcttggtgcatttgacacttcatgatatcagccaaagtggaactaaaaacagctcctggaagaggactatgacatcatcaggttgggagtctccagggacagcggaccctttggaaaaggactagaaagtgtgaaatctattagtcttcgatatgaaattctctgtctctgtaaaagcatttcatatttacaagacacaggcctactcctagggcagcaaaaagtggcaacaggcaagcagagggaaaagagatcatgaggcatttcagagtgcactgtcttttcatatatttctcaatgccgtatgtttggttttattttggccaagcataacaatctgctcaagaaaaaaaaatctggagaaaacaaaggtgcctttgccaatgttatgtttctttttgacaagccctgagatttctgaggggaattcacataaatgggatcaggtcattcatttacgttgtgtgcaaatatgatttaaagatacaacctttgcagagagcatgctttcctaagggtaggcacgtggaggactaagggtaaagcattcttcaagatcagttaatcaagaaaggtgctctttgcattctgaaatgcccttgttgcaaatattggttatattgattaaatttacacttaatggaaacaacctttaacttacagatgaacaaacccacaaaagcaaaaaatcaaaagccctacctatgatttcatattttctgtgtaactggattaaaggattcctgcttgcttttgggcataaatgataatggaatatttccaggtattgtttaaaatgagggcccatctacaaattcttagcaatactttggataattctaaaattcagctggacattgtctaattgttttttatatacatctttgctagaatttcaaattttaagtatgtgaatttagttaattagctgtgctgatcaattcaaaaacattactttcctaaattttagactatgaaggtcataaattcaacaaatatatctacacatacaattatagattgtttttcattataatgtcttcatcttaacagaattgtctttgtgattgtttttagaaaactgagagttttaattcataattacttgatcaaaaaattgtgggaacaatccagcattaattgtatgtgattgtttttatgtacataaggagtcttaagcttggtgccttgaagtcttttgtacttagtcccatgtttaaaattactactttatatctaaagcatttatgtttttcaattcaatttacatgatgctaattatggcaattataacaaatattaaagat

SEQ ID NO: 263246 - DNA, 412 bp, Homo sapiens
agaggtcacatatgtggggctaatctttcttaccccagatctcaggtttagggtacaaaactaatttcagatcatgtctgctaggatgaccaaactcctacatcagcagtaataatagcaaaaggttattgggatgcttattttatgacaggctttactctaaacactttatgtagtagctcaattctcaaactgcactatgagttaggcacttgtagtatttgcattttctaggttataaatttgatgtagagagaagccaagtaaattgttttagttcactcagctaataaatggtggtgtgcagacttgaattcataaagcttgtctccagagctatgttctttttcaccattttaggctgcctccatcccaccccaatgatggtgaaaagtataattgttgaaatgaa

SEQ ID NO: 263247 - DNA, 316 bp, Homo sapiens
tttttttgagatggagtctcactctgtcgcccaggctggagtgcaatggcgtgatctcggctcactgcaaccttcgcctcccaggttcaagcgattctcctgcctcagcctcctgagtagctgggattacaggcatgcaccaccacaccaggctaattttgtatttttggtagagatggggtttctccatgtcggtcaggctggtcgccaccgtgcccagccccaatcttctgttttcaaactatgttcggaagttgtccagtgtaggaaacttccgcatactaagcccttgaaaccgagggagagaggatgggtc

SEQ ID NO: 263248 - DNA, 564 bp, Homo sapiens
ctggggacacctcactctctggcaggctcctgctggctggagattgttaacatcgccaatcagatgttaattgaatgcaaaggaataggaaataaattctggttctgaaggggcagctggaaaggtgttgggcttctcagattccaacctacattacaaagcaggcctaaagccaagcatactccttgccagaagaaacggaaagcccctctcccgtttttagaatcaggctggaaaacacggctcccagaaggtggggttagaaaacaagagcttgcgaggcggcgccctgtggtccctcgaggaaatagtagagagacaaagagggcctgctcctgggaagccctaaattcgaagccaatccttcctcctagacatgaccacaactttaaagggcagggcgcacacctcccctcccggatctctaggacaaaggcaggtcgaggggcagccaaagaggcgcagagaagaatgacaaggtgcccagcaagcggcaggatcaaagcctgggtctctaattcccaggctggagattctgggctgcctgctcctcctgcacggggc

SEQ ID NO: 263249 - DNA, 219 bp, Homo sapiens
gaacaagaggcctgagaggtctacccacaaggagaggcatcctcctttactttaaagtatccaaggacattcctatttggtagaaacacatccagagactccaagctcaaatcctccaggataatcttggccttacacatggatgcccagacctgagtcctgtctggaaggaaagtagcttccccactttcaataaatgtataatagtgtactaacagc

SEQ ID NO: 263250 - DNA, 321 bp, Homo sapiens
gaacaacaacaacaacaacaaaaacataagaaggacaaaccagaaagtaatgataacgattacctaaagttgtagggtccatgcctggtaggtaggaagtgggttggggtaagttacaaagggcagtgacacttctctgaggatacctttctgtgtagttctgacttttagaaccgtgttagtgtttcacttgcctaaaacaaacaaacaaacaaggtggggagaaaacactaacataaaacacaaacagaaaaaaaatgaccctcattagaggtggaggaactaatctaagtaatatttgaataaagtattttgacaaaa

SEQ ID NO: 263251 - DNA, 293 bp, Homo sapiens
gggggggggtggggggggaatggggaaacaaggaggccagtttttcctctgctaaaccaggaaaggaagaggaaacatctagaaatggaactagattggaagctcaatcttttctctttgtcttaaacatgtcttaaacatttttgtaatgaagtgggggcataaataaatacctccaagtgaagttagagtgcatctgatgatgatggtggtgatggtgattcaaaaagataaatataaggccacaaattatgacagttactaccatgtacagttctatagtactatcatag

SEQ ID NO: 263252 - DNA, 484 bp, Homo sapiens
ggtgtgattttttgttactgtaatctttttatgtaattatcaaagcaagctgcaccaaacaagccagagattaatatgctgggatgtccatttagctctttctagataggcttcaatttggctaaaatttagaattattatttttcttctgagcacatcacatagatgtcaaaaagttctctccaaaacttcttatgctgtcagctttaatagagtctgcttacacagatgaaaaataaaaatttcctccttaaaaaataacaacacagagattctttccactgaaaacttgcaactgaaaattatttgaactctaaataactatagacatttagatattatttcttgagggcagaacatctttttgagttagaggttataatgagaaatcttgaacactggtggagtgataccaactccaaataaactgcaacttgcttgccttttcttcagtagcaaatatttagctctttgttgcattttt

SEQ ID NO: 263253 - DNA, 187 bp, Homo sapiens
atatgtgtaaggatgtgcaatgcaacattgtctataatatagaaaaattgaaaacaatccaaatgcccatcaaaagagaattgggtaaataaactgtgtaccactgtgcagactagaaagatttatatattgatgtgaaaagatgtccatgatataccgttcagtaaaaaagcagcttcatctgtgt

SEQ ID NO: 263254 - DNA, 400 bp, Homo sapiens
gataaggcatctggcatccatcacttgtcagggacagaggaactggagggaccctggctgcctttgggatagaatctcaaagaatgagccctgtgtttgggaccttgggacaggatcaggctgcctacgctgacatctcagctctgccaattaagagttgtatgatttgggtctgtgggtcttgttcctagcatgtgacctggcaaagagcatatccagtgagtgttgagtgaacaaaggagaagtggaagagactgcaatgaggagagaactccctggctgcaggcggctttctcgcagccccaggtggaagctcttctactgcaccagccctgtggttatgtcagatggactcaggcctccagagtgtggctccataaacaacaggaaaaaaaccaaa

SEQ ID NO: 263255 - DNA, 433 bp, Homo sapiens
ttggtcattagtatgtggtaccaattttctaatgtcatttgttattcttggccacagccagccctcccccaaaccctgcctcctttgatgcacagaatgcggagaggcaagtgatttaattatgttctcttttgaaaatctgatttggggagtgacttttatgttatcccataacatgactataaagcaaactttaaaaattaatgggcttaggaggaccccattctccccatcatcagagtgggtaggtgggatcaacaacaatgcaggtggctgatggtagctttcctagggcagaaacagacaccaaatagtcctcagagagaaaagaaccctttttctgtttatcctaagtcaccatgaaccagacagggagtttatacctcaataattaacctggcttattttctttctaatccatgacccttttcta

SEQ ID NO: 263256 - DNA, 475 bp, Homo sapiens
agccatatgaagaagattgaatctggaaccctgccttacatcatatacaaaaactagttcaagattgattaaagatgtaattgtaaaacctaaaactataaaaaccatgaaagataacctaggaaatgctgtattgtagcattctggacataggccctgacaaatatttctggacaaagatgcaaaaaggattaatgggacctaattaaatggaagagcttctgtacagcaaaagaaactatcaacagagtaaacagacggccaccagcataggaggaaatatttgcaaactgtgcatcccataaaggtctaatatccagaatctataaggaacttaaatgaacaaatataaaacaaacagccctattaaaaaagtaggcaaggaacatgagcagacacatttcgaaagaagagatacatgtgataaacaagcatatgaaaaatgctcaacattactaatcattagagaaatgca

SEQ ID NO: 263257 - DNA, 1425 bp, Homo sapiens
atcgggaccgcccgggctgcggctgatgtggaccgtccgacccgcgtgtctgataatcctttgacgggtttggtcggcggagaatggtctctaaacttcccaaaccgcccccgtttcacgtcctgtgaaaggaagtgctcctctgatgaccaatcagcggcgagaagctcttttaacgtccgtccttctttcacgcctccttccccgcgcttggttcgtgcgtccgcgccccagtgtcgggtctgcgtggatcggtccttccaggacaccgtcgccttcccggccgcgtcggagtccggcggcgacctgcctctgaaacatggcaggctcggatgctggtgagtgtctccctggggtcccagtatgtgtggactgaaaccgtccacctccagggaggcctcgggctagcccggactgggtctgggctgtcggcggggctcgtgaccttcagacgccgcgtcgcgctggcgggttccctggatagggtctctcagcttcaccacctcttcgcttcgaggccgtggaacagcagtatgctgtgggagagagagaggcactggggcgaggccggtaggacacttgggtcctggctgtaaaaagagcggtcagaagggtcgtccccggacttgtctttctgtggggcgtctagccgctgtccgtgtgccctccgcccttgcactatgggccctgaggtcgtacctgcttttgtattggtctttaaaggaacagcattcttaagatttattatgcccctgcagaatagtagaatatgcccctgtagaatagttgtgcttttttctcttcagtgccctctagagtcatgggctttgtctagcaccgcttttgaagagcgaattaatttggttgtctaggacgctttcatccttttcacaaggactgcgtacaaaccagttgtcatggtttggccagctgtgagaaatgggcgtggggagggggattatgtgcatggaaaatacactctcattcgtttccagaacgttacgtgtccagaacatagtggagatgtttgtttctaataccgattgaaagtgctttcctaccaattcccaggcatttcaaggaacaagtattttaagctaagttacttttggtacagaaaccgttaaactttgcaaatcccagcaatatctaggggagaggagaatgtggtacgcaggaaacgtcaacagtattgataattctgagcttcatgtacttcccatattttctttcatatagatcgatataataaaaaagaaaaactaacaaatgcattaccgttgatgttgttattataccagttcttaacagcctaagtttaatcaccactttttccggcaccagagaaaccctgacttgcacaagataattgggtaaacacaagaccaatactattgcaagtgcgaagcacctccattaatgagt

SEQ ID NO: 263258 - DNA, 112 bp, Homo sapiens
agcatagcctcctaaggccaagctcctgcctttcagcagcctctacaggcccagctcctgcctcgcaattgcctttgtaggccaagatcatgccgcgaagtggcctttccta

SEQ ID NO: 263259 - DNA, 416 bp, Homo sapiens
ggtccctggtgcagggggtggaggtcaggcaggccctgggcagctgattgctgcctgaagcccaccctgaggagggagggaggcaggggaggagacagaacagatcccttgggggaagcaaacccacattcccagacccaggagcgcccacgtcagggggctcccccgccacaagaggggccgtcccgggtgctttgagtggagtgagctagagagtcggatattagggccacctaggagagccggccttgtccatcgcctggccggggctggactgacgtgagctgtctccaagtccaggaggaaactcacaaactctgagctacacagcaggtatgagtcctgctgcaacacagtgcgctttaaaaagtgtgaataaattgaaacttcatgaaatagcctatatttacaatatc

SEQ ID NO: 263260 - DNA, 597 bp, Homo sapiens
ggtccctggtgcagggggtggaggtcaggcaggccctgggcagctgattgctgcctgaagcccaccctgaggagggagggaggcaggggaggagacagaacagatcccttgggggaagcaaacccacattcccagacccaggagcgcccacgtcagggggaccccagggagggccagccctgcgtgtacacccctcctgccaggaccctgcttcggaggtcacaccagctccttgtggaatggtctgttggagcggacctgacctggagaatccacgcctctcacacatggagctgggcaacagctggcacccgccccctcggcctcagcctccctgggggctcccccgccacaagaggggccgtcccgggtgctttgagtggagtgagctagagagtcggatattagggccacctaggagagccggccttgtccatcgcctggccggggctggactgacgtgagctgtctccaagtccaggaggaaactcacaaactctgagctacacagcaggtatgagtcctgctgcaacacagtgcgctttaaaaagtgtgaataaattgaaacttcatgaaatagcctatatttacaatatc

SEQ ID NO: 263261 - DNA, 337 bp, Homo sapiens
aaattcaagttaacttcagttaatgtcacttgttgttcttagaagaaacctcagcaaagctctgctccgagtcagctgctcagacagcagctgagcatgccaggcctagatcggggccagttgttccagaaaagagagttagtgtccacctcattgactgcttcagaaggcgccaccagcttcctcctggtgtttgtagcgagtgcctgtgctggcagctgttctatgtaacaactgtctggttctatgtcttgtagcccagggagttagaaaatgtaaagtattcaaaatcttctaaggaatcaacactttcctgtttgaagacaaccttggaagc

SEQ ID NO: 263262 - DNA, 352 bp, Homo sapiens
ttttttttcctgtttgggttacttatcacaatccacagttatagtattggtctatttagttggttttgatggtctctccttctagcatgtatgttttaaatgagaaaggactcaagtcaatctttttctaccattatatattgtgtctaatgccaagtgtctggcacaagacttctcttcaataagtacgtgttaagtgaatatgtttacctcttacttttctgtgtttttcagtcatattaacagaaaatccctgttacaacattttttaaaaaggctatttttaaaacattagctcagctttgttaaaggcttaaaataggtaaccttaaaagtattaccctatagttca

SEQ ID NO: 263263 - DNA, 572 bp, Homo sapiens
ctgggctgaggatcatggcccggcctgagaacccccaaggcagcatgcagaggccgggtctgcaccgagccctgacactgacaggctgtgtgacgacgactgacaactaaccctctctggttttactttctgtaagtgacttgggaggttgttctgaatgacctttgaaagggatgaaaaattggtattaataagcctgtcatttcataagcatctactctgtgtccagccctgtgcaggtccctggagtctcctctcaccgaatgctcccacgtccccaagaagttccattatcccattttacttatttatttatttgtttatttatttatgtttgagatggagtcttgctctgtcgcccaggctggagtgcaatggtgcaatctcggctcactgcaacctctacctcccgggttcaagtgattctcctgcatcagcctccctagtagctggaattataggcacatgccaccacgcctggctgatttttgtatttttagtagagacagggtttcaccatgttgggaaggctggtctcgaacttctgacctcaggtgatctaccggccttgg

SEQ ID NO: 263264 - DNA, 464 bp, Homo sapiens
gtgtaagtccaagagtccaaaagctgaagaacttggagtccagtgtttgagggcaggaagcacccagcacaggagaaagatgaaggccagatgactcagcaagtctgctcttccatctcctgcctgctttattctagccacgctggcagctgattagatggtgcccatctagattgaggatgggtctgtctctcccagttcactgactcaaatgtgaatctcctttggcaacaccctcacagacacacccaggaatgatactttgcatccttcaatcaagttgacaatattaaccatcatagcttagtgtctgaatttaaaatatgctgcaagtataaaatatgtattggatttcaaagaattagtagtgaaaaaatgtgactttcttgttatattttttgtattagtatatgttgaaatggtcctatttttgattaaatagttaaaatatattattaaaatcc

SEQ ID NO: 263265 - DNA, 454 bp, Homo sapiens
aaggagtttcaccatgttggctaggctggtctcgaactccttgcctcatgtgatctcccccgccttgtcccaaagtgctaggattacaggtgtgagccaccacaccggccttgatcatcattatcaatgcaattatttgtgacgtacttcctagccctccagagcttttaaaagaaatggaatctgactttaacttctagtgtttgaaagttttagtcccttgccatcttgcttttgagaaacgtcattagcgctgtatgttttgataggagtacagttgtttaattatggtagtaactgtaattaacttctgtgtagctctttgtggcttaccattttcatatacattaattcatttctactccacaggaagcctggcattactgattatgcagccaagcagcagtgtactattttgcctagtccccttgttccacataccctcctttctttt

SEQ ID NO: 263266 - DNA, 697 bp, Homo sapiens
  misc_feature (41)..(41): n is a, c, g, or t
ccacaccccctcgtaccaccgcacacctgcatgctccactnctcccccctccgactccccagccgcgcacttcagactgggcgacagagtgagactggatctgaaaaaaaggtgatacactacacaccacataggagagacataactttgaagtctaggatacaaacttgaatcttttcagaacataacaactagaggaggccttgcaaagatttaacagcaggaggagaggctgacagcaggaagagcacatgagaattcatagttatagctaagtgttttattagaaggtttacatatactgctctaccttttatataaaagaactatatggaaatggatattagtagggacacttcgccaaggagctccctacataataaaccattacgtcaaaacataaccagggcatgcagctttcgcagccgcggcgggccccatggccccctccccacccatatctacagctcactcaccacccacccccaacctgccctgagcagtgacgcaccaacggaagcacatctcccctcttcagctagaagacatcccgccctccttacatcaccccacgacagtcgatccgcctcacccacctgatgaattacaacggcacgacacgtgcgtcgatacccaccgtccccccatcaacgcagcgacgccaccaccggccgtactcacatcccagcggtccccc

SEQ ID NO: 263267 - DNA, 224 bp, Homo sapiens
cggcacgaggattctgatgttggatggggtggggaggtcgatgagtgagtggttaattaattttattagggggttaattttggtctggggccaactttctgacataggatgcatatttctagcatcaggacctgatccttttggtattaaaagctttttgccctcctgattcccacgttctaacacgtagcaacaggataggtccttattagcttagctaatca

SEQ ID NO: 263268 - DNA, 585 bp, Homo sapiens
gacaatgatgtgtgcaaagaaaccacatggcgagagagagaagccaaggaagccagactcttctgaacaacccaccctcttgggaatgaatacattccgtgagagtgagaactcactcccgtgggaaggcattaatctattcatgagagctccacccccatgacccagacacctcccagtaggcccataggccccacctcccaccgctgccacagtggggatcaaattttaacatgagttttggtggggacagaccaaaccacagcagtggtcttgccagcgtgtacatgataatggcatttccccccctatcctgggaaaggaattactgcacggaccttagaaagcagataaaccactctgtaagaaattaggtattttcttcttagaatcaattcagttcagtgttactgttctcttttatgtgttagaccctgtgttagatactgtggagtgacagcaaagcaatgtaaaacctccctcgactattgaaacagccaccaaagaggtcaacttcctgcctcctgcctctctccattccttctcattttctactcccgtgccagagtttatagctttccaaaa

SEQ ID NO: 263269 - DNA, 516 bp, Homo sapiens
ttagagagatgcctagaagaatgtaacacaaaatttaagaaatggttatctctatattatggtatttggacagattttaacttctttgcatttttgtttaaattttttaaatttgtttgcataagcatgtattgtttttataaaacaatagttattagctgggtgccacagcctgtgcctgtaatcccaactactggggaggctaaggcgggaagattgcttcagccttcagcccagttattcgaggctgttgtgtgccaagatcacacctgtgaatagccactgcattccagcctgggcaacatagaaagaccatatctcttcaaaaaaaaaaaaaagctattttcaaagaaaggcagggtgggggcagggctgatttggtccagtattgtttctagcaagtaattttccaggataaggctgtggctgaccttattttaggaaagggttctaatctttgctcaatggaaaaaagtgttattctttattaattataacttttaataaaattaaaac

SEQ ID NO: 263270 - DNA, 140 bp, Homo sapiens
ttgcaagaaactggtgtctctgttcccaaaggatatgtggcaaagtgaccagatgaagcttatgcaattgccaaaaaattaggttcaaaagatgttgtgatgaaggcacaggttttagctggtggtagaggaaaaggaac

SEQ ID NO: 263271 - DNA, 311 bp, Homo sapiens
ctgagaagggaaaggagataaagacatgctttcaatctaccgtctttgaatcagaagtcctacagcatattttggaggagctttgtcgaattccattctatgcctgtgccttctatttacccagtctcgtgttttgcacacttagattgttcctccctacagcttccccgttaaaaaaaacatctggtcgggtgcagtggctcacacctgtaatcccagcactttgggaggtcgaggcgggtggatctcttgagcccaggagttagagaccagcctggccaacatggtgaaaccccatttctactaaaaat

SEQ ID NO: 263272 - DNA, 380 bp, Homo sapiens
aattgagatattgccagtcaggccaaattctgggtgatgtgcggtagactgtgaacaaatgaggaaacaaggatagcaccttggcagccggcacccggaacaaagtcatccatagagtatgcaatttcccttggaaaggatgtaaacattctgcagtctagccccattgttatcagcttacagaagtttttatgagcccgtccaccttctgcagtcacacatttattaatgctttagtatcttcatcatcatatgactgatagcatagaaggcatgaacataaaggaatgactctgttatgtgtggcacatggaagtcagtcactttctaacctcacctcaagtgcgccatgaaaggcctccggctcctggacatagatt

SEQ ID NO: 263273 - DNA, 415 bp, Homo sapiens
gcacctgcccagcagcctagtcctctgtcctcgccggctgtgtcactaaaactattactttgctgtcaacagagatgtactgtccaaaacacggactcttacataaatgtttacatcctgtagccaacagccccttggagctcattaggtgaccggggctttggatttgtactgaggaagttgacttggcaccttctctccttatttttctcttctcctctgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatg

SEQ ID NO: 263274 - DNA, 736 bp, Homo sapiens
aattacatcttgaaagagcctatcttcaaatacagtcacattctgaggtccttagggttaggacttcaacatgaaattttgggacaacacaattcatcccctgtaagacctcaccctcaggaccttcaaaattcatgtctttcccacatgcacaatccattcacctcatcccaacagcccccaaattctcaacctgtttcagcatcaactgtaagtccaaaatctcatctaaatatcaacatctcaatcaggtatgggttagacttgaagtatgattaatcctgaggcaaaaccctctccagctatgaactgtgaaaccagatgttttttgcttccaaaatacaactgtgagaaaagcatagcatagaccattctcattccaaaatagagaaatccaagagaagaaagggtaatgggtcccaagcaagtcttaaatctagcaggtcagggctaggtgtggtgtggctcgtgcctataatcccagcactttgggaggccgaggcaggcggatcacctgaggtcagtagttcgagactgcactggcaaaaatggggaaaccctctctctactaaaaatacaaaaattagccagacgtggtggcacacacctgtaatcccagctactcaggaggctgaggcaggagaattgcttgaacccgggaggcagaggttgcagtgagccaagatcatgccattgcactccagcctgggcagcaagagcgaaaccccatctcaaa

SEQ ID NO: 263275 - DNA, 186 bp, Homo sapiens
tggtgtggaaacgagccaggctgctccttgcagtgaagagggaagaacctcactgttggagtcagagtaacttgagtctgaatctccattcccttgtatactagctgtgtgaccctgagtcagtttctgaatgtctctgagcctctgtttcctcacattataattatgtggctatgataattaaat

SEQ ID NO: 263276 - DNA, 342 bp, Homo sapiens
atagaagctccaggaagtagatttcagttccgcctaagaaatatggagtaaccggtgccatccaagtgtggctcaggcatcaagctgcctctttccattatcctctctccattgatatatttggaggttggacgaccaccattgacagtagttgagctacagggaggtacaagaactggaagtgaagagggaatggtcagcaattggaaggctaggaaaagaaaagttttgatgcccacaaatgtctgcttgcagcgaaaggaagtactgtgatatgaatttcaagtactttgacagctgtcattacttctccattatacattaaactgcttctaattatga

SEQ ID NO: 263277 - DNA, 374 bp, Homo sapiens
ggggaaatgagttcagtaaaatagtaggccaagtttatcagattaaaataaaaattcggatttagttcaaggagttggtgtgatctgaatgcatcacataaaatgtgtagcgggtacttctctccactttggggaatatcaaagtaatttaggtgcgtacagcccctttctgagattttttttttagttttagaaaattgtaaatcatgcacaaggaacaacattcaaaaggtagaagtcatgagctctcatttctacccccaggccttcagttctgacccagcaaaccatcactattaacagttacacatagtattctgcacttcgcttttttcacctgtaacattggcactttgtatatcaaaatacatgga

SEQ ID NO: 263278 - DNA, 553 bp, Homo sapiens
ccttaattaggttgatttggtgttcagcacaaaggcctccaccaacttgacatacatagtaggctcatcatagttggatgcaagcacacaaagatgggcttggcgtttgtctacggctttggcagcttcgcgaattccacgtgctaggtcatggtggatgagagcggtcttcagcacctcttgtgaagcagtattaacatccattacccctccagcaagcaatgccttcctcggccgtggcggtgggttacaagtgaagctgaatcttgaaggtacccaagcctccgcctccgcgcaactcggcagcggcagggaaagagaaggaatcaataactctctaggtaactcgaaatcacagacatttttaactacatttgcaacttcagaaatgatacaagacgtgcgccttgcaaaagccaattcaaacagtacagaaaggcataaagtaaaaagaaaaactgctcctcccccgcaaagccctgccccagtagcgtgtatactttctaatattagtctatgcacaagcacataaatgaatattttacaagaaaag

SEQ ID NO: 263279 - DNA, 100 bp, Homo sapiens
ttccttaccgtttgaaaaccagcgtccttcagcaacattcaaactagataaggggaaaaaacctgcaccaaataataaaacacaccaaataatggaacaa

SEQ ID NO: 263280 - DNA, 427 bp, Homo sapiens
tatggctgaaaacttgacctccaataatcaaattcaacaatgggcaaggaggctcacagggacatttgcaaatggctttattatttgcatttgccattcttttactaggaaagcagagggacttgagactcttggttggctccctacccaacccaatgtccatatgggcttaaaaatccttccattgtatataacctgcctgttttcctaagatgctgttttacttatgataatgatattttaatcccctcagatacatcctttatgatttctccaccaaaatggtatacagaggaacacccatactgtttccatcttattttaaatgtaaatgcttaaactcttgcagacatctgtttggtctaacctggaagtttccaaaatcagaagacacactaaatataaataaacttagaggcatttaaaa

SEQ ID NO: 263281 - DNA, 405 bp, Homo sapiens
caagggcagcttcagaggagctactttcagtgaagactccatgaatactgcccctcctggacccccacgaggggccagggattccttgggaagggagagacagtgacgtccactgtcacaagctctgcaagtctctcagagcattcatcgctcagacaccgtacatgagagctctgtgtgcaggtgactcttcttagtcctctaggttttctaggcaattcaattctccatgtttcccgcttcccgtcacctccagcctgcacccctcactcatgactggagatccctccacttccatcagcctgagctttaacttaaatggggaaaagcctcagggagccatcggtggcttgggaaaccacaatctgagcgcccgcacccccagaacactgaccgtttcacaca

SEQ ID NO: 263282 - DNA, 343 bp, Homo sapiens
tgctcatttgcaagttgtcttctagggtgttgcctgaacctaggctgcagtagaagtggggcttggaggtaggcgatattgaaatcccaggttaatgctaatctccatctcagatccaggacaatgcagaccagcttccttttgggaaatggaggttcttagttaatatgttctggctcttacatttctgataccgctactggtgccaacctaaatcagcagcctagttctcagcagaaggcagcagaggatggcaaggttggagggtagatagaagctgtgggagttgggtggctcctgtctgcacactggacaaggggcaccctgagaaaaataattcttt

SEQ ID NO: 263283 - DNA, 518 bp, Homo sapiens
agaaaatagatgtcttttgaattctttcttaattatcaccatgatctcccatgtgtcaatgctagtttttctcagcaaaacacagttttggtttttaacatatatcctgaaaggggaaatagttggtgatctggtatccttctttaaaagctcctcataacgtaggctaaaagaatcgcttatattttccccaaagctgaatcctttgtgtgccaaaaaaaaaagttatttaacctaagaagcaaatattaatatttcgttgagttgaaagatgtgtctgttcttctctccgtcctaaccccaaataaagtgattgataaagaaggaattatggtgatgaataattcctgatggccttttaatgttcgtttgtatttcctgtaaatgattaaggataattactctggaaagaatccggaaacaagagaaactccatagcaggaattatttaatttatgctgttacttcctttcctgccttttccctgaatgaatctaaggcaactttggtagcatcac

SEQ ID NO: 263284 - DNA, 197 bp, Homo sapiens
agaggagctttctcccgtaccatccactatgagaggaactggagtaggcatagtggagaggagctttctcccgtgccatccactatgagaggaactggagtaggcatagtggagaggagctttctcccgtaccatccactatgagaggaactggagtaggcacggcggagaggagctttctcccgtgccatccacta

SEQ ID NO: 263285 - DNA, 321 bp, Homo sapiens
ccagacccggcgacgccggccagagcccagctccatgcctcacggctctgattcactggccacatggtgctgaagtcacggctccgacagcagctccgctgagctcccaggcccggctccttccctctggtctctccttctgtctctcccatctcccttgctgagctccccaggcctggctccttccctcctgtctctcccgctctctcccttctccctcctgcactctgtctcacacacggccccatggtccccgctctccttcccttccctccctccttccctggcttttctggtttcccgtgcagctgttgtgggatg

SEQ ID NO: 263286 - DNA, 263 bp, Homo sapiens
gccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaaaggaggag

SEQ ID NO: 263287 - DNA, 809 bp, Homo sapiens
ttgacctttagctgcatctctcagtaatactaaaccattagtcatgcctgggtcagtgatgtgtcaataacagaataattattgaagatagccttaagaggaaggacatcagcctcaaatcagcattagctcaactcaaaccgccaccagggcttgttgaataaatgaatgcatgtctaataaaaggcctctttacatctggagacctaaagactgttgattccattaatccaaagggttatttgtagctgctaaacacgtttttagaccaataagtgacaggcttttactcctgctgactgcaacccacccttctcaagtagaacaaattcactgtacttaatggctctggcattttaaaaggaagttggtcagcagggctgtttggaacatctgcacctttgcagaacactaaatgcaggggagaaactcttcccactcacaggagatgcaatcttgagattctgaaatcagggtgcctccaaactctgcgctagacctctggtggaaaccaaacagcgaggtgctaataaaagaaataagggacactcagagaggcagcgcagctcaacaattaacatcagaaacgcaggaaatagatatgcacacagggagagcaccatgtgaagatggcaattgtgctgccagaagccaaggaactcccagaagctgggagagaggcctggaacacatccttccccagcaccttagagggagcatggccctgctaataccttgatcttggacttttagcctccagactggtgaaacaataactgtttattgtttaagccactcagtttgtgcca

SEQ ID NO: 263288 - DNA, 217 bp, Homo sapiens
gattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagt

SEQ ID NO: 263289 - DNA, 378 bp, Homo sapiens
cagctgcaattagaaagatgagtagaagaagtgacaaaagctacacaccatttctcctgctagagttgtctctatagtatgaatggacagaattctgtcattataagcagagtgcctctgtgaaggatggagctgtgatcccggagccctgaaagtcatctgcagagctaacagctaaaacactaatgagcaaaaataagaagcagtgacaactgggttcctctgccccagcctggaaaacagaaaattcaatatccaaatgacagacagtggaaattagctgtgattttccctgctctgtgcgaagagctggcatttcctcatttatccattcatccaacaaatatttattgagcaactaatatttcctgttgctat

SEQ ID NO: 263290 - DNA, 1315 bp, Homo sapiens
ggcttgctgaaaataaaatcaggactcctaacctgctccagtcagcctgcttccacgaggcctgtcagtcagtgcccgacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagttggacagagacttgaaccggctcccccaggacctgtaccacgcccgttgcctgtgcccgcactgcgtcagcctacagacaggctcccacatggacccccggggcaactcggagctgctctaccacaaccagactgtcttctacaggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaaacctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatg

SEQ ID NO: 263291 - DNA, 960 bp, Homo sapiens
tgtaactcattccgcagcttctaagaggcaaaaacctgtggcctgttctgcatgcatattctgcagaaggcctggggtcttgatggggaacggatcacacatgactttcgtcccctcgagagctcacctctgaaagcacatgagggaggctcttaagtgtaagtgaagatgagtctccggctgctcagtgctggtcctcacactggcgagttttatgggctcccttccaggtttcctgcatgctctcgtgtggatgtgactttgtatgttacgaacacgggatcaggccataaacacaatttgctttttaatctcacagtgtatcaggctgcacataggaagcggtctcatccttttcacagctgcttggtgctgcgttttgtgaacgtttgatcatttagccgactcccgtctgtttctaatgctctgctgctataagcattgctgcctcaatccttttaaatttgtctttgtgcacttgtgtgagattgcttcttaggaaagccagttcctagcagtgggattgttgagtctgaggggtctgttctgaggaccctgatcatctgtccagagggctgctctgagtcacacacctgccagggtgcggaggggccgtttccatcctcacctgcaccagatctgacaggtttaaacctttgcagaagtgactgggtggaaaacatctcatttcgtgggcacttccaagattcgcagtgagtggtaggggtgctcggtcctgtctctgtcccttaaagacgctccttgcctctgttcagtttcaaagttctggccaaggaccaatccctgcagcatggggccctcaaggctttgtctgtggtgtgcggggccagggcatcttatcttgagccgcagttatatgtgctgttttgttctctaacctaattgaaatttttgaacacaaaccgttgtagtgggattcgcttctcagaaatatcccat

SEQ ID NO: 263292 - DNA, 1609 bp, Homo sapiens
tggttagaggaagatgggagggaattatcttgcccatggtcgtgcattcagggatttaacatttacagttttagctacttgccaggaactggaccatctatggcatgaagggattagtcacattactgatgattattagttgcttgtattcagtgcctgacactgtgcaaagcgcattatatgcgttactttcttcttcacagccacgcttttggtgtttccccattttacaggtgaggattcgggttcaaacatgtcaattttcctaaagatgcatagctggtacttagtggactcaattcagctctgtttagcagcaaagtttggttgtgaccacttcattcaattaaagcctgtgtgctggcacaagtcatttaactagtgcagacgttcttaaccctggctgcacctgagaaatctgcatgggtttataaaaacaaaccaaatgtgatgtccggattccatcccttagttaacctgctccagagtttctgtaagctctccaggtgattctgatgtacatcctgggctgagaacccttgagctggtgagtgagcatttgcatcttaacatggctatatctgttgctttaaattaattttgggggataaattatatgctatagtagtttttaggaattggatgatcctgtctcagaatatatccttcataaatgttgaggcgccggcatttccacggatggaatttcctcttagtgacttaactgatcactgaactgtaattttggtttagcagtaatagtgccaagcgcaacagagctgtgtataggaagggtgtagggaagacgggaggtgcttggtctgctgtctttgtacatggacagctctgtgactcatgccgaggctcagtggttgctgtttagtgtattctgtcactgtctgcctcacctctgtcgtaggaattgtaaaataaggtagggatttttgtcttacagctctacattggttcataagtagggtcttgatacaaattgtagactgtcgaaagttaagtattgttctcaagtagggaaagttttctgagtttgatttttcattttcagtgtttttgtgtatacttcatactgttccttttttagaagtccactgtatatgaatttgaacccaaagtcaaatggttaagtgttcagatcattgaggtccccaagctaaatatcaccatcataaaatgtaaattctgggatacaaaagtaaatctcaaattttattaaacatttttcacgatagtaattgtattgcattttagtagtcagattttagaagtttggaattttaatataggaaaaatactttgtgggcactaccggctgctaggttactcctgtggtcactatgtcacatgtgtagtatcatctcaactggcacacctgaccaaacccaccttcatagtaacactaagctgtcatttgcccttcccactgcattggcatctgcaatgatggcacaaatacgacggggggtgaaatggtggcaacttagcctgaatcaaggcaggcattgaagtgtcctatcccaagaggccttgcattcttccctgacatcttctctccattaaaaacaataaaaactaaaaaattttaaaaaaaaaa

SEQ ID NO: 263293 - DNA, 496 bp, Homo sapiens
acagggtcttgctctgtcgcccagggtggagtgcagtggcacgatcatggctcactgcagccttgacctcccagactcatgcaatcctcctgcatcagcctcgctagtagctgggactacaggcatgtgccatgatgcctggctaagtttttttttttttggtggagatgaggtctcactatgttgcccaggctagtcttaaactcctggactcaaacgatcctcctacctgggcctcccaaaatcctgggattacaggtttgagccaccacacctgaccaaacccaccttcatagtaacactaagctgtcatttgcccttcccactgcattggcatctgcaatgatggcacaaatacgacggggggtgaaatggtggcaacttagcctgaatcaaggcaggcattgaagtgtcctatcccaagaggccttgcattcttccctgacatcttctctccattaaaaacaataaaaactaaaaaattttaaaaaaaaaa

SEQ ID NO: 263294 - DNA, 737 bp, Homo sapiens
gccattcagccatggaagatatattggaaaagcagccttttccccataaggtgacttcagtggctgggactgtctccaactgggccattaaacggctgattcttattattggcaaaaaagccattcctcttagctattgttgagccttgttaccgtgtgacagttttatatccctgactcccaagtatgaatagggaattgttagtaatgtaacttccatgtctctttggggattcctgaaggaaactgggagaggaaacaaatttctctccttggccccactgtcactgtgggaaccagtgcggttcttgtggactgctgcagaaacataagcagcattttccggttgtacaatagctgtcccatagagcaggtatctttggtaacattacctaacacagttctgctttccccagaaaccagaatgaggaaactacagcttgaattgcagcctttagaattgctagtaggaaaaactgccagaggataaatccacttgagtattttattacccagaacacaagattgattcagtagttcagagccaaaatgaactaatttgcccagaaagttggaattgctaatctgcctagaaaaccaaagtggaagtaggctatctgcctaggaagttggaggtgaatagcttgaacctgggaggcggaggttgtggtgagccgagatcacgtcactgcactccagccagggcaacagagcaagactcagtctcaaaaaaaaaa

SEQ ID NO: 263295 - DNA, 770 bp, Homo sapiens
cagctaccagtcttttagatgacctccatatggtaaagactgcaggagctcctcttaagccacccaaatgcctacccttatcctgagatggttcaacattaatttgaacacctcatcagacacacagttccttaactatcttagctataggaaccattacaacttctgtcacctactcacagaattatacccttaatattttcaaccagcttggtgtcagaaattccttgccttgctaatcacagagacccagccatgtctcttaaacatgaaggggtttatttataagtgtgcagaagtaggcattccagggatagtttgacacttccacaaagtcatccaggcatgtggcttccattgtcaaggttccagtgtgactcaagatggattttgccactctggccatcacatcctcattccaggcaacaggaaggaggaggcaagagaaggtaacaggatacgcccctgctgattacacttccactaaggagctttctggaagtcctacccaccaacttccacatgaccacacttggcggtgaggaattccggaattatcatcttttcttaagcttgttgccacactaaatagaattactttctgttactaaaaacaagggaataaatataaagcagatttttctccagtctcatttgccagcccaaaattataccattctttttctagacttttgttagttttattgctttaactgacatctccttctctgctgtactgcctggcctcttacccataagtaaatttttgt

SEQ ID NO: 263296 - DNA, 419 bp, Homo sapiens
atggaagtggctcagtggatatcacagacactgggtagggatgtgggaagtgatcagagttgaagcaaagcatgaaacagcctctggatcaccaacaggaagtgggcccacaggccccaagcttcagaatttcaaaagtctgaaatcatagtcccggtttcctgctgcacttgactgtgagcagactgtgacaaagaacaggtttggtgccgccagaatcctgttctctacatttgcttaacccgacccttttgggaactgcagggaggcaagagatcattataaagccatatttaacagaatgggctctcttggttaggtggtaaaaaaatacactggtaaacatagtagtatctcactatattagcatatcaatagtaaagtgttgaatttataaagcgagttccatccttgttctt

SEQ ID NO: 263297 - DNA, 1359 bp, Homo sapiens
gtgcagtggtgtgatcttggctcattgcaacctccacctcccgggttcaagcgatttttctgcctcagcctcccaaatagctgggattacaggcatccaccaccccgcctggctaattttttgtatttttagtagagatagggtttcaccatgttggctcggctggtcttgaactcctgacctcaggtgatccacctgcgtcggcctcccaaattgctgggattacaggcgtgagccaccacacctggccaaaaatgaattcttgttgagtacttcctatgtgtttagctctgtgcttagatgcttttcctgccttatattattggagaaatccttctattctcccttgttgggatagtactattgctgttttccttggtttggagatgtatattttcttccacgttaatgattccaaacttagggtataccttataatcagtgtggtgtgtttcccccctcaaaagctgtgattaggtacatgttataccatatcacctatcagtgccatcataggattgaggagagaaggtggtattttacattttacagataagtaaagaagtgtcataactcgtccatactttaggaccctgttttatgaagcctgtattgttaattcgatattaatttaactgctgaagttttgttagaactaacggcctagaggtagacttgtggacctttggtttcgctaaaggtagagagccaggagaggacatgcatcctaggtctgcatttggggctttcctctggctgaggaattgcaacagaatgaggaagggcttcataagtggttatggcaacattctggctgactcgtgggtaactagcatatgaaggatcattgtcgtcatgacaaattgtgttcctgtttcttgaccacctactgtgccttaggtgcttggcaaacctcctgtgtagttttgacaacacccagcagatggaagaggagttactgtctccaccttatgcatgaggacatttcagcttagagaggttaaaggccttatccattgctacacagctaggaggcagcagagcctttctgccaggcaaaggggtcagtggcagagaaatgggaccctcagggggttttcccccagatcccttccctgttccacagtctcctctctttccccattttcctgcatctggcatctagctcttgaagatagaactcccaggcctggaaatgaccgttgacctttccataggagatgggctttctccagcacctcagcctatctctctgagcctggccagccaacccctatttaaccccttcattctcatctttgttcctgtttactgcagctgccaacagcactgcctcccagtaccccaagctcagtctac

SEQ ID NO: 263298 - DNA, 363 bp, Homo sapiens
gtctgcatcgtaccctcacattgcttctagttttttttttttcttaagtggtttttcagcaacttctcttttcttccatgcttaatatcttagtagaggatgaatgctcagcttttaggaaggaggtttggtatctaaaagtacagggatctagaaaagttagtgttagaatgacattttccatcatatattctctggaatgctaaccctgtaagatgttccctactgcaaaccgtatctcccttgagcagtcatgattcatatgtggtgttaaaggtctaaaaggtcctacagaaaaaaaactgttaaattttattgtctcagtgtttcccaaccttacttgatgatggaaccacttaaaaa

SEQ ID NO: 263299 - DNA, 560 bp, Homo sapiens
gagagctcatcctaacctccagtgctgggatttcacaaaatgaaaataccttaaatatgcaacagtgttagcaaatgaacagcaacagagaaaaatcatttcttccccttttttatctccatcttcaaactttaatttaaaacaactatttttacataaactacaaagtcatagccagcagcatgtgcagcagagacagatagcctgaggttgcccagggacttttcattttatctttgcgcagacctagcactgcctgccaggtaaaactagtgtaacgagggctccggcgtctccaccacgcgtcagccctgccgaggccaagatgagcacgctgataacgcgggctgcctgacagccaggggagattctgtaaatcatgctgctcccattgattacagtcgggaagagcattaaccctccttcaccccaagatacgctgtctccacaagtgtttgtaacatcaacatgttacgggagcttttggaagatgaattcattgctagagagaagaccccttcgcaaaataaagaaatgccaacaagcctgagtattgtcta

SEQ ID NO: 263300 - DNA, 305 bp, Homo sapiens
acatctcatataacccataaatatatacacctactatgtatccactgaatttttttaaaaagaaaaaaaacagcctttaattagaatatttgcatgtcacaggctagggctaataatccaattaaagttttaggtaagggctggaggacacagggatgtgtagcacacgttgatgtacctcaaagaggggaattcttctaagaaagcgtcatcacgatttctcacctgttatctacaaccttcaacccattgctctaaaaaatcttacatttgagttgaagaaagaacaaatacgtttgtaaaac

SEQ ID NO: 263301 - DNA, 472 bp, Homo sapiens
ttaatgacagcaattgttcagggcatgtttatggaccagtctgcaaacaggaaactctacttcctgaatatgataggagttaaatgatactaactggataagatgaaaatttgtgagttaagtgttctttaaagatctgttgctgaaatgcttttcttgtgagaagaggaaagagaaagcacaagttagtgagtgagaggagcttcactgcagagaaactcaaagtcagtctttctgaaaagccctgctttctttattgaattaacatacaactagggttaacgacatttaccagtcaacctatttgcagtcctccaagagagctagttttgggtttaaaaaaaaaaaagggtaggggggctgggtaccatggctcagcactttaggaggctgagctgggaggatcccttgagcccaggagttcaagaccagcctaggcaatatggcaataccctgtttctacaaaaaaaga

SEQ ID NO: 263302 - DNA, 237 bp, Homo sapiens
gttttgctgaaatttaattggaggttgtatcatgactgattcatttgtgtttgacacatgtatgctgttaagtgccttatgatgttaattttcttgtctttctcttggaactgtcgcaagttttggacaacatgtcatcgtggatttactttgcaagtttgaatctgcatttatagattttctgcttgtgtgattttcccaatagaatgtaaatacaattcagacattaggactcat

SEQ ID NO: 263303 - DNA, 1390 bp, Homo sapiens
tagcagactgacatttcatagcattgtagctaagagataaggagcactttgctagtgacagtgggctacgaaaagtaaatagagagactttttgaaaatggtaaaagtttgagaaacttgggaagattagtgtgttaatcaggcttgctagttagtggattgcagaaagaaaaatgtaggtgattaagctctgggccttgtggtttatgaggtcaattttgcttcactttttttttggttcttgctaatcacttttagataagctcattgctcttagcatcattttttagaggttaaagcagaagtaaattgcaaacaaatctgtcagttgtgagcagatttcttttatgtgtgtggttctccatcatatttaactttggatgctggagtgttgaatagagatgatgtcagatattccaataggctatcatttaatgttaactggcaatcacctaactggttaatctcagttgagactgtgcttctgaactgggattgtcttactcccagggctgtgtaagaaaagtcataggtggatacaataatctcttttaagtatcagttttactcagatattttggtggagatattttgtactaaaacaagatctatatcatggaatagaatgctgaatttgtatgaattattcacataaagcttgatctttcaaaaaatagtttgcttgcagcaagtggtattagaacacatcctaaaacagaatgaaatgatgtcttttgcagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaatcttaaaatagtaataattaacaaagtaaaacaagatcacaccctggaacaattggaggattgcttgctgccctgcatcttaaggcgtattctagcagcaaagcttgtgatgcactgacttggggcaagtaaaactgatgctgaggacaaagggagaagatgttcctcgcccagggaaatgaaaacttttcttattcaccttgcttgtgcttaaacacttatgttcatctagtgtagaatacatggctacttgtttgtaatttttttattggtggaattaaagtaatttttccttatctttgaacttttatttagagaacttaaataaagctcttctgtctccttta

SEQ ID NO: 263304 - DNA, 387 bp, Homo sapiens
agaggctggaatggcagagagagcctggcctgagagcagcgaggatggggtcacatctgggcacaggtgacatcatgagggtgccctgactttgggaaggggccttaccctgatgtgatccgtgggggatgctgtgtatgactacaggctgaggggtcccaggacgatggtactggagcttttgggtggcgcagttgccccttggtgggggccatttgctcaggttcacagaggcactgggcaggggtaaatgttcctaaacccacggggacttccgttgttggattctcagaggacacagaaattcctttgaattgaggtttttaaaaaatgtgaaattgtgccactgcactccagcctgggctacacgagactccatcccaaaaa

SEQ ID NO: 263305 - DNA, 212 bp, Homo sapiens
ggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttca

SEQ ID NO: 263306 - DNA, 408 bp, Homo sapiens
cagcacttcccccaagtaaggacagggctgggtgtgttgtcctctactaagacatgttgaaacatgcggagaaaacaaaaaagtcatataaataagaaatttccagaaaatctttatagccaatgattgctttagtcagaagtttctttctgaaaagagctaggcataagggggagatttaagctaagcatgagattccttcccaattccacagaaaaccacttaggctcaaggtagggcaataatccacaagtacagggaacaaagcacagctagctgggatctcctgccatctcagggcctatgaagacttccaggaaatgctataatataattgttcaggaaaaggctgtgtctagatcatttagcagttggacactaatcgtcagggcttaaatagattatcac

SEQ ID NO: 263307 - DNA, 378 bp, Homo sapiens
agtaagagtcaagtcaaatttaccttgtatcaaaatctacatagtgatatggcattcgtctcagtatttggttaaaaagagcaaattggaattttctggggtttttttttcccctgaatactttacgtggttacagttatgctactgctatttttaattaaataagagtggctgggcatggtggctcacacctgtaatcccaatgctttgggaggctgaagtgggaggattgcttgacaggagttcaagaccagcctgggcaacatagtgagactttgtctctacaaaaaatattgaagcaggagattgctggagcctaggagttcaaggttacagcgagctatgatcacatcaccgcactccagtcttggcaaccct

SEQ ID NO: 263308 - DNA, 452 bp, Homo sapiens
aggagttgcatactctttccctatcactctatgcaagccaaagtaaaggaccatgagctcaccagctccagactgtggccaggaatgcaagcaggcttctagagatcagataggaagtggattcagcaacgggagtgtcagaagataatgcaagggctccacatgaatctgagaagtcctacttactctcatagccagtaggatccattaattgcattcacctttcctcacacaccaggacatcatcttaggggaagaagcaggggggtgaatacataagagattgggcattttatccaaatggaagaatgaacaccaactgagaaagacagcttaaattatcaggcctgacagctccaaacttgatgggaatttaattaatttctcttctctacctcattcactactgattgagggcttgggaaggagcctagataagctgcaaccaatat

SEQ ID NO: 263309 - DNA, 515 bp, Homo sapiens
tttatatcaaaaacccacaacatttttgatagaacactcacaattctcaatattggttacatgtagactctatctgggtaagcaatgtggaaaaaaaatcaccagacatggaaatgtctgtgccagaaactatgcagggcactgagatagagtgaaaaagacattggctcacccctgaaaatgtatgatgcagttgaggggagacaggcaatcaaatatacaattgtaatagagaatacattcaataatagtggacgtatatatacttaagagagcatgtcagatgagtatttaagtcagctttagggcatcaggaaattcttacagtgacaggattgttctctgaagaagtagtgctatgtttaaagtcaagagagttacagacttatgtgtcatatcgagaaatttggatttgattttaaagggccttaagctgaaagatgttccaaaaggaagatccaaaaggatctgttccaaaaggagaagattgtgagcaaccatagcaaatgggctcc

SEQ ID NO: 263310 - DNA, 319 bp, Homo sapiens
gaatccctctcaaaggaaaaaaaaaaaaaagagatatctgctttgcttatttgttgcatgggcagctggtatttaatttgagggataagtcccataaaataattcatattggctcatttagtagcaaacatagtaatttgggttttaaacattgaataatttctaccttgttgaaataactgtggttccatttataagataatattaagaatgagtagagtaggctggtccgagtgcagtggtatttacaacctattgatcacaaccagttacagattgcttagtttcttcttcattccctctgtttcactgaactagc

SEQ ID NO: 263311 - DNA, 490 bp, Homo sapiens
tcgtgatctgcccgcctcgacctaccaaagtgctgggattacaggcatgagccgccatgcccagcccaaaatgtgttttttctaaatcactctttaaaagagttttttaaaaaactactttactaaaaaaaagtaaatttaaatttagtaacatggcattacaatccttgggaataaaattaattttatgctgttgtcctgacaaagcaaaggaaatgcatctgaagtggcatggtttggtttggttttgtttttttctaaaattgttctactcttccaaagggaaggttttagaatgtttcccaaagcatgaatgttggaatggtggtcccatgagatgctcctctaaaaaaagaaggaggtgaaagaattatttggccaaatctgctttgaaatcctctcccttttagattcatcctaatattggcataggaatgcctctttaaagaactacaataaagaagcctgtttatctttgcttaacacagaa

SEQ ID NO: 263312 - DNA, 2660 bp, Homo sapiens
atggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgacgccaccaccctctatctgcagaacaaccagatcaacaacgctggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaaactctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctacgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcagggaaaaggatgactatatggagtcagggaccaagaaggataactccatcctggaaatccgcggccctgggctgcagatgctgcccatcaacccgtaccgcgccaaagaggagtacgtggtccacactatcttcccctccaacggcagcagcctctgcaaggccacacacaccattggctatggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctctgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggtttttttttttcccccctgaactggaaggatactacctgtacaacatctgtggacacctcatgctctgttcaaggccatcacaaaggaaccgcccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgatt

SEQ ID NO: 263313 - DNA, 944 bp, Homo sapiens
agcagattacccaggccttgcacctggatcaatgggctgccctaatgaaggatatcaaaaatgaaggggcagctaaagaaaaataaaagacacctcagaaagtagcctgcctctttgacaagggacatgccttcagaggaacataacagaaacctctgagaattgtcaacaataaaaagactgagcaacaagggaaactggtaggaagccaaaggttttaagaggtgagagtggagaaatgctgtgcttttattgatcctctccaaaggaacacctttaaaaaagcatgatataaattggcactaatcctcataagagaagaatgtcagccaagccagtgaaggaattttggagttcgctttgaagacttatgcactctccagctggtcacagacactacactcacccattttgtaaatacacttttttttgttttgttttttaagcttctcacttcagtatctaccagacaggcttgtgcaaggagtgaactagtattgtatctgttaatttctttgcaggcaaaaatcaagttaccaggaaaatattttttaaaaaccacgaacagtctaagagcactgaacattttgaatcatttgccttttctcaacactggattttaagcaaggaacaagactattccagttctaaatgctttaatgaacaaggggtattgggttttagcatcaacatgatctatcctcactctgaagctttaacttgagtagctgctgtgctttgtaaagcttcaatccaattcatttgataactacaattaccaaatctgggcattgctgactacacagttcaaaaaaacagcatggagggaagacctgctgagaaccttagaatctatcgataagctcttgaaatggtttaaagtaataaaccacttcaattgaaagggcaataaaatgtttttcgtgtatatatgtaaaaaaaat

SEQ ID NO: 263314 - DNA, 659 bp, Homo sapiens
ttttttgaaaggaagtaaagtacacttggaagaaggccaagaaggcaacttaagatatcaagtgtgccaatccaatttgcttttcattccatggggcattttcagaatacccagcttcccagtatcttcagaatcacagcttccaaaggtaacctgcatttctaagagaggccaactcataaatgacagaatgtctgctcaggataaatcttcccccagtgaggcactgcgcttggatagatgactgagcaagttacacaacccagggtctcaaatgtcattatgtatggattacctggatttaattctatattacactattatcatatgttggtagagttcaagatttgtctggatttcagtatttaacaattacaccacatatagcataagctgattaactctttccaagtactctttattgtataggaagtatcaagtggcctatttccttaaactacaaactcagttgctagatgcaataggaatgaaactcaaaagagaagactcagagataagtcatctgtaataagttaaaagctctttgctactagaatacagagaagagtccctaaccatggtaaaactggtggtagcaggaaaagttctgcctgacatccagctggataccaccatcccaaatgccagggattatgtgt

SEQ ID NO: 263315 - DNA, 418 bp, Homo sapiens
ttttttgaaaggaagtaaagtacacttggaagaaggccaagaaggcaacttaagatatcaagtgtgccaatccaatttgcttttcattccatggggcattttcagaatacccagcttcccagtatcttcagaatcacagcttccaaagttctgccaagtcccagaaacagacagccagccatggctaaggcacataacaacaacaacaacaacaacaacaacaaccaccacaacaaaaacccaaaaaggctgttggatgaaagagagttgctcacatactccacagcaacacagagctttgatacccgcaatgtgagtttctaactcttactctattggaagcatttctttctctctttgaagagggtatacgatttcaagagaaaaaggaaaatcctgaaataaaaacaaaacaacc

SEQ ID NO: 263316 - DNA, 105 bp, Homo sapiens
tatgacctcaggttaaggaaggatttcataaaggaaacaatgagtaaatctggcattttgtaaatgatattttctacacatcaaaagacacctctaaataaatac

SEQ ID NO: 263317 - DNA, 411 bp, Homo sapiens
ataaatggtctttcttcccgacccccttaaaaaaaaaacacacaaaatcaaccaactatagcatgctaagatgaaatgttgacttcttccctccaggttggagacaaggcattgatgcccccactatcaccattattattcttaaatatactactagaaattctagccagtgcagtaagacaagagaaagaaagaaaaggtacaactgctgaaggaaataaaactgtcattacacatagatgatgtaactgtataaatgatttatctatagattcttttgggtttttaagaaagtataaaaaatgtgactatgaaacaatatttttaaaaatctatttttatatgctcacaaacaaacctttagacaatgaaattaatagcaaatgccatttataatagaatcaaaaaaca

SEQ ID NO: 263318 - DNA, 227 bp, Homo sapiens
gtttcactaattcatagggtccaggctaaacttctagacacctaagtcctagccatagaaccaggcctcagttttgtcacacggcaggggaaacggatctgttctgagtggtcccagcacagttgtgaccccatttaacaaatgcggagacagagacttaacaaatttaagtcatttgccttgggatacatagctaataataataaaagcattaacaacggtatgaa

SEQ ID NO: 263319 - DNA, 624 bp, Homo sapiens
caaactctattaaaaggattttcaagggccgggcaagatggattacaggcgtgagccaccgtgcctggccattatgactgtacgttttggtgacacctggttcttacgttagaaatcaggctgctgaacgttctgctctgtgtgtgtctttgtgcccattcttgttggcttccttagagggatttctggaagttcaatgattatgtaaaaagcacaagccttgctgggaccctggagtggcgttggagtctctcgtggttaggagcccaggccctggcctggccatcgggggctggaatcctggctgtgtcctccgtagccatgtgccccaggcagctttcctcaccgcctgcctgtcatccagggatgcaggtaggtcctgctccatggggttgtcatggcgatcacagagacttgtccgtgtggaccacctagagcagtacctagcagggcacctggcgccctggggtcaccttggatcagggttgcagctgacccactcccatccctcccaaaggcccttcagcccagacttttgtgcaccccaaattccatcaaaatcctttttcctttgagagtaactttattcatttccctgcagcttattaaagaattctgaagaac

SEQ ID NO: 263320 - DNA, 727 bp, Homo sapiens
tgcaaactccgcctcctgagttcaagtgatttccggctaatttttgtatttttagtcgggatggggtttcaccacattaaccaggctggtgttgaacttctgacctcaagtgatccgccctcctcggcctcccaaagtgctaggattacaggcgtgagccaccgtgcctggccattatgactgtacgttttggtgacacctggttcttacgttagaaatcaggctgctgaacgttctgctctgtgtgtgtctttgtgcccattcttgttggcttccttagagggatttctggaagttcaatgattatgtaaaaagcacaagccttgctgggaccctggagtggcgttggagtctctcgtggttaggagcccaggccctggcctggccatcgggggctggaatcctggctgtgtcctccgtagccatgtgccccaggcagctttcctcaccgcctgcctgtcatccagggatgcaggtaggtcctgctccatggggttgtcatggcgatcacagagacttgtccgtgtggaccacctagagcagtacctagcagggcacctggcgccctggggtcaccttggatcagggttgcagctgacccactcccatccctcccaaaggcccttcagcccagacttttgtgcaccccaaattccatcaaaatcctttttcctttgagagtaactttattcatttccctgcagcttattaaagaattctgaagaac

SEQ ID NO: 263321 - DNA, 479 bp, Homo sapiens
actgaaatgatgagccagtagtcgtctttttatgcccatcctcttccacctccctctccacaaaaataaataaattaaagaaattcagcacctgtggaaaactctgccaagaggaaattacctcctgtgtggtttgtcagattcatgttcttcacactttccatgggaacaaaggctgtctacatatttcctgtcaagtgaagacaatggtgaggctctgaaaaccattttgaatccttgggttatctggggaggaagttattgaaaaaaaaatagcctgtaggaaaatgtttgattccattttattcaggctcgggataaatttcttatggcatttcagggcagtggagaagtcacggggacaggagaacagtgggtgagtcctgtgtcaatcagagtgcagggctgtgttttctggctattgccatgtaacaaactgtttcaaaactttgtgacataaagcactgattttattatgc

SEQ ID NO: 263322 - DNA, 514 bp, Homo sapiens
ttgttactgtagaaagtgtgggtagggagcctcctattctgccatcttgctatgccatatgttccgatatgttctatgtcaaatttatctgattacagattcagaatttctgaaataaagtactcagatttacacattgtgtaataagtaaatgtattgcaatgcttcattctcattagagcattttattaattattgaaatgcatttgcttttattgcggcgcatggcatgtcaaagattcaaaatgccagctcttcataagtcacagttgaaaactagttatttaaaggattgtttttatgatacgtctgtattatattcaatattttataggtcagaattttctcttgttttcaactgtattttactggggagtctcttttcatgtaggttctccttgatcatttacttttttgtgtgtttttaatcttcatatttgtatggtaattttcaactttgtaccttttatgaccatgtattgtttaattccaataaaaatcattggagcaagtt

SEQ ID NO: 263323 - DNA, 331 bp, Homo sapiens
  misc_feature (124)..(124): n is a, c, g, or t
  misc_feature (143)..(143): n is a, c, g, or t
  misc_feature (156)..(156): n is a, c, g, or t
  misc_feature (181)..(181): n is a, c, g, or t
  misc_feature (209)..(209): n is a, c, g, or t
  misc_feature (227)..(227): n is a, c, g, or t
  misc_feature (232)..(232): n is a, c, g, or t
  misc_feature (237)..(237): n is a, c, g, or t
  misc_feature (249)..(249): n is a, c, g, or t
  misc_feature (264)..(264): n is a, c, g, or t
  misc_feature (266)..(266): n is a, c, g, or t
  misc_feature (274)..(274): n is a, c, g, or t
  misc_feature (279)..(279): n is a, c, g, or t
  misc_feature (296)..(296): n is a, c, g, or t
ggtaagcgttagtttttatactctgtagtagaccttgtatcactacataggcctgtcttctgtccttgaatttttttaagtttaattttttattgactgggtgtggtggctcacgcctgtggtntcagcctccagagtagctnagactacaggaanagataccatggagatgtgcacccanaggaaaggccacgcaaggacacagcaanaaggcaactgtttacaanccaanggaanaggcctcagganaaccaaacgtgtccncnccttgatnttgcncttcccaacctccaganctgtgagcaaataaatgatgttgtttaatcaaaaa

SEQ ID NO: 263324 - DNA, 538 bp, Homo sapiens
tgtaacattgatagaaaaccggaaggaattaaaaacaatgcagatgggtgtacttcctttctctcccagtcccaagccaacccatttttccttggaatgcaaaaatggtctggaaagagatatgggggtcctgtgaacagaacagggagtcattatctttttcttctttaccaatagacgatgacaaatgtggatggtgaggaagtaaaacgtcaataaagcagtatcataaataaaaaaataaataacgtttattctgtaccacgcggctgtcagtgtccggagtctccagggcagagcgccccggggagggctgggccctcagagcagcaggagggcgcccagggacagctcaccctggcccagcaggcggccccgatcccggccgcgaccctcatcccgggccttgacgcgaacggccaggcggcgcacctcgtcttccgagaggccgtcgaagcaaaagtcctggtcaaaggaggccttgcggctgcgccccaccacagcgctgcattgccaacgcgcagtgcccggcggccgc

SEQ ID NO: 263325 - DNA, 499 bp, Homo sapiens
tgtaacattgatagaaaaccggaaggaattaaaaacaatgcagatgggtgtacttcctttctctcccagtcccaagccaacccatttttccttggaatgcaaaaatggtctggaaagagatatgggggtcctgtgaacagaacagggagtcattatctttttcttctttaccaatagacgatgacaaatgtggatggtgaggaagtaaaacgtcaataaagcagtatcataaataaaaaaataaataacgtttattctgtaccacgcggctgtcagtgtccggagtctccagggcagagcgccccgggacagctcaccctggcccagcaggcggccccgatcccggccgcgaccctcatcccgggccttgacgcgaacggccaggcggcgcacctcgtcttccgagaggccgtcgaagcaaaagtcctggtcaaaggaggccttgcggctgcgccccaccacagcgctgcattgccaacgcgcagtgcccggcggccgc

SEQ ID NO: 263326 - DNA, 426 bp, Homo sapiens
gagagctggaggcttgttggtttgctgctctttctgtctgtccatccatcagtttgaagcaggtaatacatttacctgtttctaaagtcaaaataaaattaaaattatacataaggaaatcctgctcccattccttcccctttaccctgcatctaccgtcaatactgataaccgttttaatgaattccttatttttccttctagtatttatttatgcaaatacaaaaatctaaacattctcatttcttgtaagtattttgactgatgagaagataagagaattaagacattgagacacaaaaccatttttaacgacctggagcactctactgctctagaacaatcttaattaagaacatatgctaattattcacctctcagcataaaagcttattaaaaccaattggctgcaaatgaaagatgaag

SEQ ID NO: 263327 - DNA, 395 bp, Homo sapiens
cttctgtaacacaaaacatcatcaatactttagaaaacctcattctgactgacttctgagtaccaatcaatattccccaaaacacattatagggatctgacaactggtttatattcttatattgtgtaagaggtaaggaggtgctaggtgtgagacaagtaggagagaggaaaggatgggtccttagacacagcagaaaaaccggaagatgacattataaagataaaagacacatgcccattgttgtagacgggcatgtgcatgtcagcagaaaaccctaaagatggttccctaaacagtgatgagtaggatttttgatattttcactcattccccaagaggattttccctcctaaacactggtcactgataatcagaaaaaatacaaaaaaaga

SEQ ID NO: 263328 - DNA, 206 bp, Homo sapiens
ttgtaatagagaaagaaaagagtgtcattggcagactatggttcaattgataagttgaaggagaaaatgggtcagagtgtttcgggcagtggatttgggggtcaatctcctgtagctagatgatcaatggatttgaaggatagacatatctaacatgcaatttgaatttacttttacatattttgctgatgtattttttagtagaa

SEQ ID NO: 263329 - DNA, 432 bp, Homo sapiens
agggtcaggttggtgtcccaaagtgcctgactcctccctggaattctcccacctgtccaccagggaagactgagaatcctccttttacttgggagccctgtgatggacacctccccgggcttgggctctgcaggcccacacagaggacagagagatgtgccgaggtgcctgcgttatgggccctcttagttggactttcctctgctgctgcaggccctcagccccggcagtggcagcatggtgctccagatctcctcccagcagctagctgctccaccccaccacccttcttgtctgtgactccttggagaggatccaggagccatgcagcaagaagcctgcagacctgtcacctcccacactggagaggctcccgtgaagcccggcctcagcagtcatttcccataccatgattctttctctgtttaaaaa

SEQ ID NO: 263330 - DNA, 511 bp, Homo sapiens
ttctaattacagtggacctgaacctttggtgagctggagtaattaaactattcggtgggagcaaatcattacccataggagatgaatatgtttttctaggttgctgattagagcactgaaagaggaaatttacttaatagtgcctggaaaagtgaagggcattttattttcagatagtagcttattcacacaaaatcaagccggatgctgttatactgtgatcatttttgtaatcacttcagttttactgaataaacctgagtcatgttatcagagtggaagggtggtttcaggataggtgagaacaagtacaaatgcaacagcgaagaccttcccctgagaatgagaggtgatggctgcttttgttccattaagaatctcatgactgggtgcagtggctcacgtctgtaatcccagcactttgggaggccatggcaggtggatcatgaggtcaggagatggagaccatcctggccatcatggtgaaaccccgtctccactaacatacaaa

SEQ ID NO: 263331 - DNA, 719 bp, Homo sapiens
cttcatagtaatagtgaaaattatattttcttgttcttaatttacagctgaagagactaagattcctagaggttctaagtggaaaagctatgtttcttttctctagatgcctgctagtcaggagggaaacatctgaaagtccagttgcttctgagtcatgaaaaataatccaaaggtattagaaggcaagagagttaataaagagagttaagttactggattttaccttggcatttctctaaagctgttaaactggatacttagattaattcgggggactatgatgaccaagtcctgtgatgattgtggccgtgatgtagagtggataatagtttgaccttttcttgatcccagtattgcatcatcctcttgagaaatttatggatatccctgtactcacaggtaaaggacagtaagcgctaggaccaagggctttaaccagaaaaactgctgaataaacctggggtcatgggttttcagcgcgatgtactttagggaagatgagagggtgcaagaaatttttgttaattaagagagacagaaaaacttagtggtaaggagactaaatatgttgtcaaactgcttagattggaatctcacctccacatctatcttgcttgcctatgcaagtgatttaatgtctttgaacctcagttttctgatgtactgtgaaggttaaatgtaccagctcactcatccacatttacagcatttctctc

SEQ ID NO: 263332 - DNA, 314 bp, Homo sapiens
tagggatgtgtgagcagagtcttagcgactagcttctcctcctccccatatcaacacccttcaatgctgacttctcaaagtatggtgctagggcgtcacctggaagcttgttacgcctctccccagaactactgtgtccgaaactgcatttaaaccagatcctcgggggatttagagctggttaacaaaatgaccagaggattaaagtttggaaatctccaatttcgactatattgattacattgcctgcgtgttcaacaactctgacaatatttgacccaataaacgagtgcccagcaaggtcaaagcacaac

SEQ ID NO: 263333 - DNA, 484 bp, Homo sapiens
agcctgttgttataaaatgacctgtaatctcatctctcaggtatacttgctagtatatttaatactgccactattttttctttgtctagatatgcatacatgtttctctttgacaaaaatgacattatattttaatcctctactgtaatcttcttcacttaacagagtcataaaattttttcttgcctttataacagaattcaagtattatttttttacatgtgtgatagtctatcatattctttgctactggaactagttttctttcttgcttttacaaataactaaaaaaaatgtagagtgaaatctcaattacagaggctcctgccattttcaattcaagtctctctttttcacaaccattagtatgaattctgttatagtacctgtcagttaatgttttttctaaacaatttaatctcttaggtaaaaggtttttttctttaacttttcagatatttgacctgtttactgaacaagtata

SEQ ID NO: 263334 - DNA, 394 bp, Homo sapiens
ttttgctgggcagattatgttcttaactaaattctctcttcccagagattagatttttaaaatttccttctagctcctgtgatcgtcatccagacaactttagtgatttgatttggccacagggtttgctgttttcatttcatcttgttactccactgtgctggtgatatttccattttcaaagtttgtttcaggaacattaccatttttgctaatattgcctttgtacttgagtttccatgctggcttttacttccagagggaaatcaggtttttttgtttgtttattttgttttttgccttttctttttagtatgtttggggaagacatgatcagtttgagctaacagtaaggagaaaataaaactataataattttttttttcagaaacat

SEQ ID NO: 263335 - DNA, 541 bp, Homo sapiens
aaaaaacaaaaaacaaaaaccaaaaacaatccacatgtaatgggacctacgcagttcaaacctgcattgttcaagggtcaactgtattttgatttctcaatcctagtgtttctttgttacgtaaggggagtcttcaagcagaatagcacagagatgcgctaggaataaccatggtatatacttgcgcaatgattttcctaaaagattttgtagaaaatttcggcacagcagtcatggtattttagaacctatgacaacaaaaatgctgacctggttggcctgattttccctgaaatgaggctgtttaagtttgttatagaaacaaatctagcggtaatcctttattcctctgtggtcttattcaaaactagtttttcttcttccttctcaccctttctttctcgccttttccttctttctcttcattctttcttttgaatcaacacaagtgtttacatttcaaaattcttcttttctcagttctctgtttttttttttcctagggagccgctcgtttgtgtgtgtgtgtgtgtgtgtgtgt

SEQ ID NO: 263336 - DNA, 754 bp, Homo sapiens
ctgcagctctcagcagaagggtctctacccccaaagctgaaatacatgtgcccttgccctaggcagagcctctggctctgaagccacggacaggctgacagggaaggggctccactgagtaggggaacaggtgggatcttgaagctacccctaggatatcttggagggggtcttatttagctctaagaacaaagattgtggctgacgtggctttagagctgaggatgaggggagaagtgtgggcagcatgtatccagtcctgccatgccatctaggggcacccctccctggggcttctctgacctgattctggaataaatgactaagacaaagaaaaggactctagggatagcttagcacagaacccatacaaaccacccctaaggtttctaccagaatttccttaggcttagtaattccccaccctgacatcaggaagggatccagggttttccatcttccttttctagcaaagggaaaaaaaaaaaaagtgtctcacaacaatcacacagcctaccaagctacatccaaaaagagggtctgaggaagggctgggcgggcacctgactgtccccagagcccatatcatgcaatgcctgccttgtccaataagcccagccctaggagagcactgctcccttttaaaactctggtctagatgtaggcttttgtaaagttcacttggaaaatgccggcataatggacacccaaaagaaaacaactgcagaaaattcaggcagcattaaagtgttgt

SEQ ID NO: 263337 - DNA, 179 bp, Homo sapiens
cagggaggccaagttgtaatcccctctctcctggatgaccacgactgcccacagcagccattgcattcaccatgtgcatggtgacctttaccaaacacaaatgtgactttattattgtggttccccatgcttcttcccttagcaaacactctcagtgcaaacacatccacatacacagc

SEQ ID NO: 263338 - DNA, 223 bp, Homo sapiens
atttttttttagtttaacataactgtttacatttgcattttcattagcaaggctgtacattttccatgtagtattattccttctctcatataaagtctaactgtaaattaaccaccactggtttttttcgcaacattctctctcccaccatgtataaaaggtttacaacttaaaatttctggggctaaaccattttttaaaaatactttcataaaaacatggg

SEQ ID NO: 263339 - DNA, 548 bp, Homo sapiens
tgcaataagtgtaactattgaatctatattgaagagccacaagacactgaatttaattggacgagactattttatttaggaagacaatcatctcctgtgatcagcttaaggtttttgttttgttttatctggaacaagctaagttcatatttagaaaataaagttagttttttgggtgcatgagttttagagtaaattagtaatttagtaaactttgacatttccactttgtctccaaacacatttaaattctatctgtctgactgaagttctaaggcattctgtggttacttagaaatgattccttatattaatgtttacaaatgctaaattgtatttgttaaatacatgtcttattgcctaagagttttcctttcttataagtttaatataaatgtctaggaaataagactcccatttaatagcttataaagaatgctgatgtatcagcagtggccttgacattattggatacaagtaagatctacactgatgattaaatcaaattggctaagattattcgttctaataaaagcactgactccatg

SEQ ID NO: 263340 - DNA, 422 bp, Homo sapiens
atattcatcttttgtgtcatatagttctgtgagttttgaaaaatgtgcacagttctataaccttaccataatcaagacacagattattgctctcatccccacaattccctcattcccgtttgcactcagtctttcccctaaccctagaccctggcaaccaatgattaatttttttctttgcaattctgcatttttgagaatgttgtatggatggaatcatgcagtatattgtgttactagtctgacttctgtttagcatagaacatttttgttccctgtatcaatagctttttctttcatgttactgagttatattccattatataaatgcaccacaaattgtttatgtattcacaagttaaagggtatttgggttgttttcaggtttttgtaattatgaataaagcctctataaacatgta

SEQ ID NO: 263341 - DNA, 499 bp, Homo sapiens
tgagtcttgccaccactgtgagtaagcagcctcattacccatttcacaggagaaacaggctcagtgaggtcaggtaactgactctgactcccatgctcctctccctggagtttcacgtggacatctgttcaagctctccctttactgccagtagcgtttatgtataattaaaacagctggcatctgctgagtaacaaactaacattacgacccattctcactcttccacttgatgcctgtggaagttactatgcatctccacaaattgaactttgtatctttacctaacatcctatccatcctttaatactttggacctggccaggtgtggtggctcacgcctgtaatcccagcaccttgggaggccaaggcaggagggtcgattgagcccaggaggtggaggttgcagtgagccaagattatgccactgcactccagtttgggtgacagagtgagatcttgtctcaaaaaaacaaaaaccccaaattacaagttggac

SEQ ID NO: 263342 - DNA, 445 bp, Homo sapiens
tgagtcttgccaccactgtgagtaagcagcctcattacccatttcacaggagaaacaggctcagtgaggtcaggtaactgactctgactcccatgctcctctccctggagtttcacgtggacatctgttcaagctctccctttactgccagtagcgtttatgtataattaaaacagctggcatctgctgagtaacaaactaacattacgacccattctcactcttccacttgatgcctgtggaagttactatgcatctccacaaattgaactttgtatctttacctaacatcctatccatcctttaatactttggacctggccaggtgtggtggctcacgcctgtaatcccagcaccttgggaggccaaggtgggcagatcacttgagatcaggagttcaaaaccagcctagccaacatggtgaaaccccgtctctactaaaaat

SEQ ID NO: 263343 - DNA, 299 bp, Homo sapiens
ggcacggccactctggagaagcgcagcggcttcgtaaacatctaaacatgcatgcaccatgcaacccggcagccacgtcctgggcacttaccccagagcgatggaaacgtatgctcaggcatatttacagagctttactcacaaaagccaaagcccagagatccaaatgttctttgcaccgtggatgaataagggtctataaagcagcagcaccaggagccgtgcagtgcaggatcctcctgtatcttgaccgccacagtggtggttacaggaagctatgcacctggaaaaactgcagg

SEQ ID NO: 263344 - DNA, 614 bp, Homo sapiens
ggaaagctttctctgatgggttcataatgaaagacattttataagagttgagttagagaagggatttgaaaagagaagagatgcaggtggtaggatttggagttacctgaaaggggagtgaacctttctacaaatgaagcaggttttcttttgcttccttttatgctttcctatttttatgttatcattccccaaggctctaagtcacgcatgtgcttctttaaataaatctcacaagataaaagccaagtgcatcaaaatcaccaggcattgatgcctgtctgtaaaataaaatcacacactaatcatggagtatagattcgctttcttccctaaggcaagacgttccctggcacctgtggaggtgagccccagcatgaatgatctgtttttgacagtcttttcatacatgaaagctcattgacaactcacctaggcacacaatttaacaatcccaactagcatttgtgtttgctgtgaaattatgcatccagaaaaccaggaagtacttcttcagccatgcccatctgttgctgccttgaaaagtctaacttggccatcaaatttaatttaatagtgctggctggctacatgtgggtatttaagttaaaatt

SEQ ID NO: 263345 - DNA, 442 bp, Homo sapiens
tgtaaaccactctaagataccctttttcgtaaacttttactaaatataacattcagaaaaatgcacggatcataagggtacagttcattgaattaaagtgatcacatttttataatcactacttatgtcaagaaatagaacattataaacaccccagaatcttcctttgggccctttcccaacctctgtcacctaccttcttccaaaagagaactattggctgggcttagtgactcatgcctgtaatcccagcattttgttggggccaaggcaggaggatcatctgagcccaggagttgagaccaacctgggcaacatggggagaccctgtctctacaaaaacttttaaaaaattgtcccagctactcaggaggctgaggtgggaggatcacttgagcctggaggtcaaggctgtagtgagccatgattgtgtcactgtact

SEQ ID NO: 263346 - DNA, 507 bp, Homo sapiens
aaaagaaaaagaaaaaagatgaaagtttgggggcatacctgccgatggtaacaaaaaagacaatatagttctataatactttaccgtttcagattgttttcccttgcttgttcttgtggtgatgaggtaatgaggctgggggagacagaaagaagcaggaagagcctctgagaggggagggtttgagcctggccgaggagacacagtgaaaatttgaagaaacctttccttgggattctgtccaggagagctctttggggtgtttgcccagcttgggagcaactgtgaacataagtctgcattcacaaaggaaagtgctatccccaaggggcaatcctataagactttgatcttcatatttaagccaccactctcttaattgacttaggacagtgaaattccttaagagaatatctgtcttttcaaacagaggaatgaatatttcagagtcttttagtccctttttactgtttcttcctgggttaccctagagaaagactttctaaa

SEQ ID NO: 263347 - DNA, 386 bp, Homo sapiens
tacctccgccaggtagaggttgaggagacagagcgtggagaactggagacaggaggggaagcagtagagcagccagtgggggaagaagtgcaggtgagcgggcggccggagcaagggcagggagccgctgagcgagaaggcggcggagaagagggtggtcctgagcgctgcccacaggagacagaggaagaggcagaggctctggtaactcagccgccgctcgcggtacaggagcagccgccacagctgcaggtaggcaaaggcgaacagcgcggcgtagagcagggcgtgcaggacgctcagcgccaactgcacggagcccggcaccgcggcgcctgaggctgcagcgacggcgcctccgcctccgctgcccccgccgggcgtgg

SEQ ID NO: 263348 - DNA, 421 bp, Homo sapiens
cacgaggactgccactggggattaaagcatccctcctcccacacagcctaagaactgcctgcctgtggctatagttactgtcagaaactctgcctctactccaacagcaggactgcagcatacttggacataccctaatggcaggctttccctgcctaccacccctgttgtagcagactcccaagctctctactgggagcctgagtgtcactcctctctgcccaccatagccagggcctgattacattcctggggtccctggaaacaggcctacctggcctggcactccccccactccagtgccctagaacactgtctaagggcttgtctcaccctgtccaccaccactggcatctgtgcagtcctcctagggctgctaccaccacagcagcacccactgcacatactgcctagggaatga

SEQ ID NO: 263349 - DNA, 597 bp, Homo sapiens
gtatcagctggagtctatgaataatatttcatatatgtgtactactagttttcaaatgatacagtataagagtgataagagtatgggccaggcatggtggctcacacctgtaatcccagcattttgagaggccgaggtgggtggatcacttgaggtcaagagttcaagaccagcctggctaacatggtgaaaccctgtctctactaaaaatacaaaaattagccaggtgtggtgcacatgcctgtagtcccagcttcttgggaggctgaggcaggagaatggcttgaactcgggaggcagaggttgcattgagtcaggattgtgacattgcactccagcctgggtgacaaagcgagacttcatctcaaaaaaaaaaaaaagagtatggactctgaggcctgattggctggattcaaatcccagctccacacacagtagctgtgagattttggacaagttcctgaggtctgtgctatacttttcttatctataaaatggggataactgcctagctcatgaaattattatagggattaatgcaatttaattaagtgttggctatctttattaaatagctattagtgttattatgattaa

SEQ ID NO: 263350 - DNA, 789 bp, Homo sapiens
aaaattatctaacattctcccccccgattgggacaaaaaaaaactctagtgggtcctcggttgtgtcttcaggatcatcgttgcctgccccatcaccatcaaaggagcctctcagctgcagtggtggatccagcccatccagtggtccacctgggaggtctcagccaagctatctcaacacactcctctgcttggaattggtactatgtattatctttgttttaggatgtagggtaggaactgagtctattaatgtttttctcaacactgtattcccaggcctaataaggctagtaggtgcagtaataacctgttgttagagcaaaaaagatggcataagttgtctcccttgttgtttgagcctctttgaaacttttcattggtagtgaacacaaaaaggattaaagctctgcctaccaacatctctgccacaagagactggcccccactgtgagaatgctctgcctgatctctgaagattcacaggcttccaggcacgatcatatctcttctaagtcctgcacttacctgaggtcaaaagcctttaaattggtacaggtggccgagttgggatacaacaaaatgcattcagacaatccgatcctgtgatctggcaaaatgcaaaacattatagccacttactaaaaactgggtaacattgtgcagaaactcaggggacagatacaaatgattgtttgtccatattgatttgattcctgtaagctaatgaagaaattaccttgtgacatcaaagacctagtactcaataaaaagagaaaacattcaaaa

SEQ ID NO: 263351 - DNA, 459 bp, Homo sapiens
aaaattatctaacattctcccccccgattgggacaaaaaaaaactctagtgggtcctcggttgtgtcttcaggatcatcgttgcctgccccatcaccatcaaaggagcctctcagctgcagtggtggatccagcccatccagtggtccacctgggaggtctcagccaagctatctcaacacactcctctgcttggaattggtactatgtattatctttgttttaggatgtagggtaggaactgagtctattaatgtttttctcaacactgtattcccaggcctaataaggctagtaggtgcagtaataacctgttgttagagcaaaaaagatggcataagttgtctcccttgttgtttgagcctctttgaaacttttcattggtagtgaacacaaaaaggattaaagctctgcctaccaaccaaataaaaataatcggcctttgttggcctcaaaccga

SEQ ID NO: 263352 - DNA, 529 bp, Homo sapiens
atgcctctgctgatatgacaagaggtggagctcaggtggtaatgccagcaatggggagcagctgtaaatacagatgaagctttgctgcttgctcactgctcatctccttctgtgggctccagtctgtgtccttggggttgggggcccctaccctagtccacatttaatgtaatcatttaaacttttgacattcagattagggaaaaaataaatcttactttaattgaacagtttttctcatgctcattgattgtcatacttctgaattgcctattcatctccttagcctatttttctaaaggattccttatattcttaacgagttacagaagccctctattatccagttcatcctttgtaatatatgttacaagtacttttatttggttacttgtctttttgctctgttatgaaagttttaattgatactatttgaaatctgtccactttttctttgaggtttctgagttttgtgcaggaagactttatggatggtgtgagataggaataaaaacattttttcctcaat

SEQ ID NO: 263353 - DNA, 304 bp, Homo sapiens
ccttattgacaaaatggaagcttccataaaaaaccaacttggatacccactgccatcgtggttatcccaggcaactacagtcagcttctctcaacccaagggactcaattccaaagagggagcagggagagggcagctgcccgcgaccccattaatttggatgtttggctccagatgttcaatcccaaggacatcaagtcagcatttttctctgaagactgtaaaagaacagctgcatcttctagaagaccatccaagtccatgtcttgttaggatgattacagtgttttacttgtagcataaa

SEQ ID NO: 263354 - DNA, 995 bp, Homo sapiens
caatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctc

SEQ ID NO: 263355 - DNA, 974 bp, Homo sapiens
caatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctc

SEQ ID NO: 263356 - DNA, 241 bp, Homo sapiens
tgtggttaaagaaacaaaatccaacaatcaaaaattatttcacagctcctattttttacttgcatttcttgaaaatcctgagacatattcaaatacatagtttttacttacaaaaatacttataggcctggtgcggtggctcatgcttgtaatcccatcactttgggagaccgaggtgggcaaattgcctgaggtcagtctggccaacatggtgaaaacccatctctactaaaatacaaaa

SEQ ID NO: 263357 - DNA, 431 bp, Homo sapiens
tctctctgttgctactgcagaatcatttatgagacaattagggtatgcttgcactttttttttttccctcccctgtgttattctaggaggatgtactatcttaatagattaaatacttggtgaatttgactttgtctggttatagaccattctgaagctaactaaccaacaggagggtcaaatccacagtttaaattctgatcacaactaaagtgtcctcaattcagtatcagaaattgagtctagaggggagaagccagaaagagtggacgttagccatttgattgggataaagaggcttataggctcaaactttctgtttcctatgggctatctgtctctctctttttaaatggcaaacctaaagatttgtttcttgtacatctggtgggttccagggaaaccttgtctttggaatcactatttctctt

SEQ ID NO: 263358 - DNA, 405 bp, Homo sapiens
cagagtccaagagaaatgccctgcccagggtctggcagaactgatggagagcagccttcgtggctaccaccttcccataaagtctgtgctctccagcggcgcttggtaataagatttatttaatgacacgtgtaactctaagactatttgtgatggcgaataccacagatttgactgggtttgagttttgattatagacttcgatggagaaagcaatggcgccacaacccagccagggtgccctgccaggacttcctcatctcttgcagtgaaacccccttatcaaacattacgtgctatctggccccctttgtcatactttcttgcactccacttactacatatcaaggatttgccatgttgtggaaaagttggtttcataacatattttgaactcttatttaa

SEQ ID NO: 263359 - DNA, 398 bp, Homo sapiens
cctcaagtgatctgcgcccggcggatttaacattttgatactgtgttctcacgtggtgaggaaagatatctaaaacggtaattccaggtaacacgaatatttttagttctgtattttatttattattatactttaagttttatggtacatgtgcacaacgtgcaggtttgttacatatgtatacatgtgccatgttggtgtgctgcacccattaactcgtcatttaacattaggtatatctcctaatgctatcccttcccccctccccccaccccacaacagtccccggtgtgtgatgttccccttcctgtgtccatgtgttctcattgttcaattcccacctatgagttctgttattttaaattttttcacaacatagagcaaaatgagttgctttt

SEQ ID NO: 263360 - DNA, 930 bp, Homo sapiens
cactgtgtaggtgtgtcccaggtagtggttccagtgaggagcctagagcaaaatttggattgcttttttttcccaaatttcatttctttttctttagtcatatattcattcttaagcatgtggcaggcccttactgtgtcctaggccccatccttggtgctgagaatgcagacgtgaaccagatgtggtctctgccatccaagggacttaaatatcatcatttatgaaataatattcatctcacatgcctatggtgaggattaactaaggtaatatatgaaagagtgtggcaaattgtggatattgagtaagtgtacttttcttttctgataaagttattgttgatcagacttctttggtttagttgtctctttcattgagaactggatagaaaccaagatcagagtttaggtgaactgacagaaatcacccaaagctaggtcttttttggtacctttctaaacaatgccctttggttttctccctaagaaaggtgatcatacttttctggagaacatgtgggaaaaaaaagaaaagaaaaaaaaaaaaacacctgtgtgtgtggcgcgcgcgcctggggcccctggaagaaagctttcaataaaccaactccgggtggggcgcgcgcggggcgccaagagtggagcaaaggggacacggggccatagacgcggtggttcccaagaggagagaatcgcgcgggccagagcacaagagcgggcgggggaattctccacaccaaatatataaaaagcgcccgcgggggaacaaagcgagagagcgcgttcgtgaggacacaaattctccgagagaggggaatatcagcggaggggaccaaaaacgggggacctcctctacacaccgcgggggagtctcaagagggagacacctgaatatttcaacattacgcggcccggaccgggggtagga

SEQ ID NO: 263361 - DNA, 378 bp, Homo sapiens
aggggtgggttctctgaaaggccctgcacacgtctcagcagacagagaaggccttcagccctgatgatggtgttggggggcggtgctgaggaaattaataatcatctcatctttgtccttgggtctggaaggaagaagtgcgggggtgttgggggggattacaaagatgacaatcttcccggttggtttttctcagcccctccacgggcctggccctgtggtgcctgggtctccagagccagccacctccatcctggacaccggacaccttaactggggctcctttcccctgtatgggctgccagtactggctgacattaatgggtttgagaggagaaaagaccccctgggagcctgtaaaaccttagtcaggaaaag

SEQ ID NO: 263362 - DNA, 274 bp, Homo sapiens
ggcctcagtttctctgtcagcaccagatggggacttcttcagcctgacactccataactcaaggttgcacccacatctcctacctttgggggaaggagagagggattatgggacagtggcatcaatctccttcccaggatggatcctctgagctctatatttcttgcctatagtgaccagggaattttcctctattgattgctttctgtaatcgagcttaacaaatagaacttccctcaaatgattcttccaactaaactgatagaaagctaac

SEQ ID NO: 263363 - DNA, 283 bp, Homo sapiens
attgtgccactgcactccagcctgggcgacagagtgaaactctgtctctctctctctctctctctctctctgtgtgtgtgtgtgtgtgtgtgtgtgtgtgtgtgtgtgtgtatctctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgta

SEQ ID NO: 263364 - DNA, 359 bp, Homo sapiens
gtgcaatgtcccctgtgattggctgggatttctgagcttttcagcttgcatatggtgagaatgttggcacaccgcagccctgagggcctgggctttggactccggcagtcccacatgtgtgtgctacctctgccgctctctggttgtatgaagtcaagcaatgtctgtaacctcactgagtcacagcgctctgctctgtagaatggagatgggatcctctctacctcctgcagtgtctgtgaatgccataacacaagccagagtgctgagcaccgtgcccaccctagaagagggctcggtgtatagtagcagctcttaatgctcccaggatgcctaataaattctttcagaaaagtatg

SEQ ID NO: 263365 - DNA, 167 bp, Homo sapiens
tgagaaagcctctgctctccccagtatggctataccacagaggtttgtctaatgtgtgagttgttttgtattcgcttcattagaaagccttttaaaatgcattttcaggtctgtgttcagtacagtgtgtatccaaataaaaattctctggcaaatcaccttaagaa

SEQ ID NO: 263366 - DNA, 446 bp, Homo sapiens
gagggggaaaagattggatgtagggagatcagatgagaggctattatagggatccaggtgtaagctgatggtagcttatttagtctgttatggttgatggccatacaaaaagaatgattctctgaagtaatgtatttatatacatctgtggtcagcaattcataactcctgattgccaggttaagatttccaatttaggggccgggcacagtggctcatgcctgtaatcccagcactttgggaggctgaggcggggggatcatgaggtcaggagttcgagaccagcctgaccaacatggtgaaaccctgtctcaactaaaaatacaaaaattagccgggcgtggtggcgcatgcctgtaatcccagctactcaggaggttgaggcaggagaatcacttgaaccctggaggcggagcttgcagtgagccgagattgcgccactgcac

SEQ ID NO: 263367 - DNA, 533 bp, Homo sapiens
caaaacaagtagtaagatggttaatttaagtagtaacagacaaaatggactttaaggcaagacatccctagaaacaaggaaagtttgtaatgaaaaatgagtcaatccaccaagaaatatgtatgcacctaataacagagctttaaaagacaaaagccaacagaaccaaaaggacaaaaagatagattcagtgtccctatttcttctattatacacaaattagggagagcaggatatttgttgaatatggcgtaaattcacagaccaactttcatattatacttaatggtaaaaccctgaaagcagtctcttactgttataccttataacccacccctagaatttctgcttcccattctagcaactgagttctgctgggatttggagttcttattttccaatagggaatgttactaccagaggacacagaaaggttccattgaattgaaagatgaggctataacccatttgggactgttgatgccactgaaccaacaggtaggaaaagaggtcactctcctgactagagtgct

SEQ ID NO: 263368 - DNA, 644 bp, Homo sapiens
aagaggtgccatgcactccaggagaagagctgactggatcctatactcaaagaatgggccacggatccctacctgtccactgtttgttactgggctgggaagctgcaagacccgatgctggggagcccaccatgaaatctgtcccaaatcatggaaccccgaggtgaaaggcccccaggcatgccaacacatggcagacaaatccagttgtgtccagggatggcgttccctccagttttctgaaagacgctcccatattccttaagcacagggatctactaaaggatgtgctccttaaaaatgagggagtaagccgagaaagaggaagatgtgggctctagaaaatggaatccaatgcagcaaaaggtaaaggggatttttagaatcacgaccaagagaactctgaggtcaacacctgtgcagcaggcctagagaatgatctgtgaagatgggtacaggaggaggagggactctaggtgggagggctctatcatgtggtggtactggtgtcagcccattggagccaattgttaaatatttgggaatgttgtaagccagtttttaaacacagtcattatttaaaaagtaaattataaaaggcttaatcatattagaaataaagatgataaatattccaaattcaa

SEQ ID NO: 263369 - DNA, 284 bp, Homo sapiens
gaatacattagaagtgatatgtgcccgttcccagctctctcctttgtgaactttgtcttcatcttgagaacaagcctgggctagcttgctagaggatcagagaccctgtggagcagagaagagtcagcaaaggcgtcctagccagagtgagatcagtaaagccatcagcactactgcagctgaccacagatgcctcatggagtcctattgtgcctggcttagattaaagaactgcccgtttgacctgtagtcttgtgtacaataataaatagttgttagataaa

SEQ ID NO: 263370 - DNA, 390 bp, Homo sapiens
atattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttaccttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtga

SEQ ID NO: 263371 - DNA, 400 bp, Homo sapiens
aaatattttggctgacttctgtatttcctgagctgtgtcacctcttcttcatttaaaaaatagtacctgtttgttgttgttcgtatttttatgttggaattttgaaacaaccaaaattccaaaatttttctgtttggaaatacgtaaaactagcaacagactttgagaaagtgagaagctcttcttatgtatattaatttttgtaaaaattacttccagaagataatcttctgaaaactatttcagttgaaggtatttcaaaaatctaacactttagagtagatttaaagaaaaatttaaaattaaattcctgtgatttatatcttatttgatttttcatcctaacttcattttctccacttttctttcccttacttctcttgttaatacaaaaaagaaa

SEQ ID NO: 263372 - DNA, 333 bp, Homo sapiens
agctatatatttttctataggctgctgcacatgtcttgtatagggtggcagagaatagaatactgggagaagcaccagagttggatacataatgccttccatatggtcatgactctactccagttggctatttggcctagaaccagctatttgtcctagaaccgattcagaaattaatatctctgaattttacttttctcatttctaaagcagagataataatgtatttgcgtttaagttatataatgtttctgtgaaaatcaaatatgcttcaagtttccttgtaaactaaataatacatattttattacaataaatgcttattgaaatgca

SEQ ID NO: 263373 - DNA, 2551 bp, Homo sapiens
  misc_feature (46)..(47): n is a, c, g, or t
gggaggagaatggagtgacagagacacgcggagggtggggggtggnngggggagcgtgttgaggggagggggggaggggggacacagagggaggaagaagcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatca

SEQ ID NO: 263374 - DNA, 547 bp, Homo sapiens
gtcactgtaatcagagaatgtgatgtgcttaatggccaccaaggagatggaatcacagtccccagaactgctggcatgtccatacagaaatcagagcattggactgggggtgtggggtggggagtagaggctgggtcatcactggtgccttcttctacactgacgtctctctgagtctgtgaagaccatgaaatgaagaaggcgttctgagagtttgccagtcaccttcctccatccatctagggctctgagcccaggtgtgggaatgacaggaaggccctgcctggccttctcctgggtctcatcacattcttcttttcttgtctccagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaaggtaaggagtcttccaaaccccacagc

SEQ ID NO: 263375 - DNA, 773 bp, Homo sapiens
  misc_feature (46)..(47): n is a, c, g, or t
gggaggagaatggagtgacagagacacgcggagggtggggggtggnngggggagcgtgttgaggggagggggggaggggggacacagagggaggaagaagcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccataggggagctgagcggatcgctgatctcctggagctcatccaccaaggagcatgggagaccaactgaaattaagatgagatgacaaatcaagaaagttccacagggtatggagcaggttgctgagctgcagaaccaaggcaaagatctatccccacttccctggaggaagtggcgtccctcctggcttaaaggatctctctgcgagctccctgagggcctggaccacaggctctccatctgggcgtctccattgctgtagcagcatgagtgggtggatggatgttgccttctcttcaacctggaagccaggactgtgagtggc

SEQ ID NO: 263376 - DNA, 455 bp, Homo sapiens
ttgaggacccctcgcgacggtatgtttcctgtggattctgagtcttggcaccatgagaccagtgtgggattcttctttcttccaggcaaccggtgaccaaaaacactttcaggcagtatcgagtgctaggaaaagggggcttcggggaggtgagtgaacattcacgtttttaattgaaagttcttacattcaagtcacctttcctgtcccttctaaatcaacctaaagggttggcccacgggtcccccgggggcaccagtggctcaatgtgggccccgggggcagtgagggtgggagagagtcagtggccttggggctatcaggtgtgtctatggtggaaagaggttgtggagctgggcaggtgagacagacgtgctctcctgccagcctcaggcaggatccagcctgcagaggacaaatgggcagccctggtcgtgtgtggggaggagatgtga

SEQ ID NO: 263377 - DNA, 373 bp, Homo sapiens
ggagtccgaggatacagtgagctatgaatgtgctgctgcaccgctccagcctaggtgacagagcgagaccctctaaaaaaaagaaaaagagagagagagattccttgccacccatctctctgcttccagtgtgagccccacgtatgaactaacggattttcaacagaactggcacagggcagacagaccatgagaggaagaaggggttctctaacgtctgctcagtgaaacatcaaatagtgactttattagttaatgggataattgttcatgggagatcattagagagcccaaatcaaagaatttcttaggatgtccgaaacttggaaggctggaatgtcatcacgaagataaaagattgttgaggtctgca

SEQ ID NO: 263378 - DNA, 2428 bp, Homo sapiens
gtcactgtaatcagagaatgtgatgtgcttaatggccaccaaggagatggaatcacagtccccagaactgctggcatgtccatacagaaatcagagcattggactgggggtgtggggtggggagtagaggctgggtcatcactggtgccttcttctacactgacgtctctctgagtctgtgaagaccatgaaatgaagaaggcgttctgagagtttgccagtcaccttcctccatccatctagggctctgagcccaggtgtgggaatgacaggaaggccctgcctggccttctcctgggtctcatcacattcttcttttcttgtctccagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatca

SEQ ID NO: 263379 - DNA, 2513 bp, Homo sapiens
  misc_feature (46)..(47): n is a, c, g, or t
gggaggagaatggagtgacagagacacgcggagggtggggggtggnngggggagcgtgttgaggggagggggggaggggggacacagagggaggaagaagcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatca

SEQ ID NO: 263380 - DNA, 1065 bp, Homo sapiens
catcatctgaggtggacaggaagcccagccaagccactggggccgacccctcccctggactcacctgcatctgagccacacaccctccagccactacccatagcagttctgggggtgtgtcctgggaagactcccttctgctccccaaaaccccaaggcctggctcggggccactggagccgcaggcgggacatatgtgtgaccggccctctgcccctggcagccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatca

SEQ ID NO: 263381 - DNA, 416 bp, Homo sapiens
ccaagattctctgacctcagcgttccaggaagcccattcagcctttgactaggcaggtcggtcaacgtccagccgggtccaggcatcctattgcatctttatgttccactcctgaagagtgggcattttcctgtgtcctcccacacctgcactctcccaaggctcttgtggtcactctgagatggcagattggggtccctgttgtccttggacagatgagaatgccgagagctcgtatgccttgcccaagggcacacagcaaggccgggtgcccatgcggctgtcccagggacccactgaccctgctgtccccctcaggccacattgccacattaggatctcagacctgggcttggctgtgaagatccccgagggagacctgatccgcggccgggtgggcactgttggctacatgg

SEQ ID NO: 263382 - DNA, 373 bp, Homo sapiens
tgaagcgggaggaggtggaccgccgggtcctggagacggaggaggtgtactcccacaagttctccgaggaggccaagtccatctgcaagatggtgagctcctggtggccagatgccaccctcaagctggtggctcccctccctgggcctggccccagtctgtccccagaacagcaaacaggctgaagggacaggggtctgagcatgggggtgggggttgcagcccaccaagctagagttgagggcactccttgctgtggactggggtggtcagcggagacttccaggagaaagcctgggtggggcagggacacccaggaaccaagggaagaggggtgaggggaacagtgtggaacaccctcacatccagcctg

SEQ ID NO: 263383 - DNA, 354 bp, Homo sapiens
aaaggatctctctgcgagctccctgagggcctggaccacaggctctccatctgggcgtctccattgctgtagcagcatgagtgggtggatggatgttgccttctcttcaacctggaagccaggactgtgagtggcagccatgagcactgagacagattcctaggccaggtgcagcggtgcaggcctgagcattgagacagattcctaggccagctgcagcggcgcaagcctggaaccccagtgctttgaggggcggaggcaggaggattgctcaaacccaggagtccgaggatacagtgagctatgaatgtgctgctgcaccgctccagcctaggtgacagagcgagaccctct

SEQ ID NO: 263384 - DNA, 483 bp, Homo sapiens
ctggagagcatcttgtccaccacccattggtggtggagtaaacaggcttcaaggggagagtgacccgcccaggagagccaggtccctggtctggagtgacaccttgcaactccccatgagcatattgctgcataaacgtgtgggcagggccccagccagtactcaaggcagggagactacttaggtgctcaaaggggtggacgtttctgtctctcttgtatcttgtaagtgtgtgcagcgagttcctctgcttattcaatgcatgtttagtgagcactgaaaacatgctgtccacgggggagctgagcggatcgctgatctcctggagctcatccaccaaggagcatgggagaccaactgaaattaagatgagatgacaaatcaagaaagttccacagggtatggagcaggttgctgagctgcagaaccaaggcaaagatctatccccacttccctggaggaagtggcgtccctcctggctta

SEQ ID NO: 263385 - DNA, 1322 bp, Homo sapiens
tggcggggctgcgggagctgagcctagagtccggctgttggctagagtgggcgcggatctggtgtggggaaggcggcgggactcaggcctgcctgcgaacattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctcttttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctccccgctcccccaacccacaacagtccccgttgtgtgatgttccccttcctgtgtccatgtgttctcattgttcaattcccacctaggagtgagaatatgtggtgttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgccgaaataaacatacgtgtgcatgtg

SEQ ID NO: 263386 - DNA, 347 bp, Homo sapiens
gaaaggtccaaaagatatttggcataggaaaatcaagtgtatccttttttgctcaaagaatttcattaagatggaattgacattcaaaccagatgagagcatctagattagaaatacttctgtgccataaaaaaactcattctaattgtctttgatttctttttttttttctagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattaca

SEQ ID NO: 263387 - DNA, 388 bp, Homo sapiens
tggccctagctagaggtggactcagcacctcgggctgttttccacacccctatgatttcatctccaactaataggaagcaaccatcccctacccgcctgcccaccaaattgtcaataaaaaatatgaactccaagccttgggagagactgatttaagtgataactgtagttctcccatgtgggctggccttgtgacagttatactatctctctactacagtaccagagtgtcagtaaactgattttgtctgtgcagaagacagaaaaaaacccatcagatgattacattacatattttagatcataaacgtatgagtttgaactaatgacaagattgcagataaaagtgcagtggccattgttacctgtatatcaagcatagcagtga

SEQ ID NO: 263388 - DNA, 551 bp, Homo sapiens
gcccagctcttttttcctctctccctccccctgccacccaccccaccataaaatataatcaaaaagctggtaaataatttaaagaattgcctcaaaggatttgcagactagaaagagactcccttctctggtttaagttgggagaaactgttttcattttttttcccccaagatatttaaaatattcaggagtgtcccacagggtcttgaacttataagtgtctgcatttttctcactatactctcatcccctcttttctttattgatttttttaaggttgctgtcggcaacatttaggtccaactttcaaatgaaaatcatatttcagttactggtcttaagtcagaccaacttaaggtctgtttcattcatctcagttctgtgccccctgctctttagtttaatgagagagtggagggaatcttggctgctgtgatttttcatcctattagctctttccaaagggatccttatcttgtgagcagaagggagtgatgtcttatatgtggagtcactgtgtatctttttagagaaacttaatcatccctcc

SEQ ID NO: 263389 - DNA, 502 bp, Homo sapiens
atacttgtatacaaatatagaaacattatttataatatccgaaaagtggaaacaacccaaatgtccatcaactgatgaacagataaaaagttgtggtatatacatataatagaatactattcagtaataaacaatattgaacttctgacacataatacattgtagatgaaccttaaatcatgtcaagtaaaataagtcagatacaagagaccacatattgtatgattccatctatataaaatatccataaaaagcatgctaatcaagacagaatgtagattaatggttgccttggaatgggcatgagaaaaacaattaaatgttaataggcatgatggatcttatttaaaggataaagatgttctaagatttagttatgctgatgtcttccccactcaataaagttaataaaaatcattgacttgtatacatgaaattatgaatgaattttataatatttagaatattcctcaataaagctgttttaaaaataaaaaatgat

SEQ ID NO: 263390 - DNA, 542 bp, Homo sapiens
cagagaaagagggttttgaaaaactttcttttcctgggccttgttgctcaccatgtaacaacatcctcttacttttcctgtggtgggaaagtaccctgtagtactagcaaggtgcacccaggtagaggacaacaggaatagttatcctacttgctcaggcttacatttttacacatgaaacatagtttcttttacatgtttatttacttatttgttctcaggaagactgacagctgggtgatgtgaaagggacattatgttctgatatccttcagatagagaaatcctaaattgctgttaatttcttgtgcatattcagctgctggattgcatacatcacatcactagcaacctgtgcagattggccaagggatggagtatgtggcattgggaacagagattgtccttggagatttctgctgtattccctgcaacttcaggaccttcttgctcttgaaagttgcagtttcatattggctgctggaccagtcctgtatgatgtgccacttatcaataaaatgaattggtttctccagggtgtg

SEQ ID NO: 263391 - DNA, 181 bp, Homo sapiens
acatgtttaaaggacacagattcttatcagcaaccaacctgatctatataacctttatattttttgatttggtcaattgcagtggtcaagtccccacggtcaacatgctctgcaggggtatgaagcctgacagcgtagagaagattaaggtattcttcaaatcttcgggatgggtacagca

SEQ ID NO: 263392 - DNA, 259 bp, Homo sapiens
aaaaggaggcaggaagcacttcagctggacacggagaggaaagtcatgcatatcatgactaactttgggaaccacaatggagggacgctggggcagttcttcctctgcaagaacttctctccttagaaatcgaatagatgggccagtgtggtggctcatgcctgtaatcccagcactttgggaggccgaggtgggaggatcacttaaggccaggaatttgagaccaggctagacaacatagcgagaccctctctctacc

SEQ ID NO: 263393 - DNA, 573 bp, Homo sapiens
gctgctgtctcagagtcagtgctcttgccccagctcccgctgacgttcactgagttcccggtgtgggccgaggctcttgtagtcggaggctgacccgcagcctcttcacagaaaccagagccgcgctcttcctgctgtcaggcaacaacagctcagcacagggcctgacacacaatagatgtcctctgaatagccaaagaaaaacattcttggggtttctgtggccggcagcggcaccctgcgtcctgggtgtgaagaaagtgggggatccccctgattttcccctcctctatctaccagagaccttctgtcctactttagtcctcagccccacctcaggtggctaatgaggatggtgaagaaaacctcagagaacaccctccagggctcctttcacctccctcacccaagcagtttctctcataggaagtggggccaaaaaaagaagaaaaaaaaagaggcgaactcaacaaaaccgtctattggggggagcggccagtttgtacccttgtaacggaaactgttagaacaactttgcaccctccttaaaggaaacagatgataaatccttct

SEQ ID NO: 263394 - DNA, 410 bp, Homo sapiens
  misc_feature (1)..(1): n is a, c, g, or t
  misc_feature (3)..(3): n is a, c, g, or t
  misc_feature (228)..(228): n is a, c, g, or t
ngnctccagcgttttgtgattttttttctcattggccaatatcaatttgtaatgagccaaacctgacttgagtagcagatctacaggcccatatcttggaggtatataggtatttggctgttgagggcatagattaggaggtctcttgacattctgttgctaggttactgaaccctgaattactgaaccttgaacacagtatttgtgttctcaaattggtatttatgntcgaaagcagctgctattcatatttttttgggggggaatacagggaaatataaaataaataaaactaagtagttagatacagtgcatcaaaaagtaattgtaagaaaatgttattacaaaccaggtaaaagagattgattcccccttcctctccatccaacatcagaagaattatagtgttc

SEQ ID NO: 263395 - DNA, 260 bp, Homo sapiens
aggaagttgcacttttacctcatccctcaacagttcagatcctctcaccaggggcaacccctatttttggattcttgtgctaggatatgttatcaaatttttttaaaaaggtcagaccaccgtatgattccatatgtgtaaaatttagaagattacatatatatttgcaggtgtgggtatgtgtacaatatatatatgttatacatatacacaatacaatatataaaatcaatatatattattttttctaaaacgggact

SEQ ID NO: 263396 - DNA, 459 bp, Homo sapiens
gtctctctacctggagagactttctttgcagggcatcttgaattattctgattttttagttgcgttcagaaatggctaattcctggagagataaaccagatgcagattataaacttgtgtgatggacctactcatgtggggaaacccgtggcttcctggcagtgaacttggttgcagcaaccaagaaaagaaagacccttgagcaggattggcgcataatcactcccctcaatattatcactccatgaaccaatgttagacctctgcacaggtggaggttcgtgcttgagggccattgaacactacccatttccctaatgcatcataattaaacacctgtgctaagtaacttcttactgatccactgtggaaatttgctgggtgctcaacagtccttaacattttctatctcttacttgggagggaggtctcacggttattctttggttctcctggaaa

SEQ ID NO: 263397 - DNA, 446 bp, Homo sapiens
tacttggatgtttcaccagcccctcaagttcaatgtttaacgccctgccctctactcagtatcaactattcttactatgtctctgggactggcaacgctgttcactcatctgccaaaatcagaagccacatggcagtcagtcatacccagtccttaaaagtgaacttttcctttgagtctttaaaaaagttcacttaaaagtgaacttttcctttgaggggtcttttcctttgagcagctttccaagaacccgatctaattttaatggcctcattttgagatcctgtagcatgctgtacatatttttaatcttctcataccatactatgacacctgatttatttcttctactagactataaactccttgagggcaggtaacacaccatgttctttggatttccaggccaagcaaaatgcctagatggtcaatgaacattggtcctc

SEQ ID NO: 263398 - DNA, 468 bp, Homo sapiens
tagctgggattacaggcacacaccaccatgctggctaatttttttgtatttttagtagagacggggttttgcccattttggccaggctggttttgaactcctgacctcaggtgatccacctgcctcggcctcccaaaactttatgcatctttaaataaaaacttgtattattccctttagctctttttgtggttacggaaggtatttttcttgtcagttatttacataaaattgtttttggatcaagaagcattaacaagacatgtttattatgcataaattcttataaggaataaatagctggaaatcatcatttgcttctccataatccactatgtggaaatgtagttttattgctgtggaagtctgattataattttgaaacataaatttcaaatacaaaattgtgaaattgaaccacctgctggttaacgagggttttgcatcgtgaacttgttaaaccaaaaa

SEQ ID NO: 263399 - DNA, 569 bp, Homo sapiens
gtgaaagtagacaggcacaaagaagatgccgaatacaattactctcttccctttgctgatgtctactagatggtgactttttttatggtagctaatgtttctagatctttacatttctcattgtccctagcacaacacctggtactgatgaactgtcaataaatatttgttgaattgcatcagttttgtcttaagtaggctctgattcagagccatccccaatccatgcaaactaaagaggatgtaagtaaatattaataaaggctggcctggttttttaattgccctcaatttcaaaggctagagatttaaagaaatatttacttaagcctctgtttatagtttgaattggaaacaaatctgcaaaatatttttaataggagctaatacagatagctgacggaatggggagaacctattaaaaaaaaaaatttagctaatctttccaatcacattcttccttcctccccacccccatctccttggaattatgttatctctgctcgtcttaaaagctcagaagccttttgaattggagtggcattcaaaggacagtcaagggtcaccct

SEQ ID NO: 263400 - DNA, 1371 bp, Homo sapiens
  misc_feature (416)..(416): n is a, c, g, or t
gagcattcgcatagctgcgggctgatctgccgccggcagcactagcggaagcgactgtgcagaacatgctcgcgcgggcggtgaggtcagcggacccggacgtgagccggagtcgggggctgttgcagaggggcgggagggagtcggtgagtggggggatggaatggggggaggcgaaggggcgggggacccgggctggccgtatgtgtcttggggctaactaggccgtcgctgtatggtgagccccaggaggcggatctgggcccccagaaggacacccgcctggatttgccccgtaggcccggccgggccctcgggagcgaacagcttggtgaggtggacggaggggacctcgcgagcgacgcgcgcgccaggacagagcccgccccggcctctcgggagccggggggcagagnctgcgagccccaggagggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctaccccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagccaattaaacctcttttcttcaataaatt

SEQ ID NO: 263401 - DNA, 483 bp, Homo sapiens
  misc_feature (128)..(128): n is a, c, g, or t
  misc_feature (131)..(131): n is a, c, g, or t
gttgagactctggactttggacttttgaattaatgctggaatgagttaagactttgagggactgttgggaagatataactgtattttgcagtatgagaaggacatgagatttgggagacaccagaggnganataatatgatttggatctgcatccccaccaaaatctcatgttcaattgtaatcctaaattttggaggttgagcctggtggaagaggattggataatgggggtggtttctcatggtttaacaccatccccctgggtgctgttctcatgacaagtgagtagttattgtgagatctgattgtttaaaagtgtgtgccacctcctcccactttcctcctgctccagccatgtaagacgtgcctgcttccccttcgccttctgccgtgattgtcagtttcctgaggcctccccagccatgcttcctgtacagcctgcagaactgtgagccaattaaacctcttttcttcaataaatt

SEQ ID NO: 263402 - DNA, 1255 bp, Homo sapiens
ctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgagtgtttgcagctgagtgttcacagggtgttaacctatttgagctttcttttgtggttcgtaatgcaggagatttctgcctttgcaggccggagccctcatgacttcagtgacctgcttctgcccctctaggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctaccccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagccaattaaacctcttttcttcaataaatt

SEQ ID NO: 263403 - DNA, 222 bp, Homo sapiens
aaagcaggcaagtaccttttgctggtttgctacacattaaagcgacctaagacagagtttttgaaaatactgatgcctgtgtcctaccccagggcaattaactcaaacttctcaggaagacagtgtgaataccagtgagtatttaacactctacctctggtaactgtagagtgtatagacagagctgagaaccgctgcctacacgaagaactctcaaacctg

SEQ ID NO: 263404 - DNA, 355 bp, Homo sapiens
aaaaaaaaagaaccatgcaatgaaggcatcctctccttccttttccctgttttgatggagtaggtctcagaactgggaaatgaccagggataattttatttcttagatatttgttagattttttttaatgtgttctttttttaaatctttaaaaagtgtttttatagtttaaggtagccattgtgagactgtatgaaacagctatatgaaaatgtcttacatcatgaaagaaataatgcttttacaaaaacagcagtgctcttcaatatattatatgtatatactatgttacgtttgctttacgctttgcagttttacaaaatgctttcaaataaattattttgtaggttaaata

SEQ ID NO: 263405 - DNA, 395 bp, Homo sapiens
caccttctgcacgctcaccatggggcaggctctgccgtctctctctcacccttgctccgtccgctcattcccctttctgggatatttcacaagcacttgctaggcaccaggcagtgtgctaaggccagggacacagcagtgagtgagacaacatcccacacaaagaaaggcctgcggcagtgtgggtaataaaaagtgccagggggtggggtggcattggagctcagaggtagagggagagggagatctgggtgctgccggtgcaaaggtcttgagcagggggaggtgggccagctccagtgatgcctccagaggaacttggggctttcttagggagtggtggatctgacgcacatgttttagagggatcccttggtgggaggggggtctctagt

SEQ ID NO: 263406 - DNA, 787 bp, Homo sapiens
cccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 263407 - DNA, 468 bp, Homo sapiens
cttatattaacacatattttggtattaaaatacaaaataataaattacatgtttcttgccttctttttttcttcccatttaaccacctggatctttccctggagtgtatatgtctctacttccttcttgcaattggtacaaatccattgcacagggggtgcctttgtcatttccggggtgttgccctgtctattgccgctgtgaacatcctcgtgcatctcccataggaccagagatcgctccctacctccctctggcaggacttgctgggtcagaggacctgagctttacatttaaagagaagctgccacattgacttggcttttctcatgaggtgattgatatattcccatttctcctccagacagtagcatttctgtggcagggatgtgttcagacttcagacttcgcttctttctttgcatccttcctgacttaggttttgtattctcctagttaaacaggaaa

SEQ ID NO: 263408 - DNA, 437 bp, Homo sapiens
cacagtgctgcagagattttgtttatggccagttttggggccagtttatggctagattttggggggcttgttcccaacattatgcctgactcaaagatcctaaatgactaaagtgcttagaacagcagctccccacagtaaactctcagtaagtgttagctgtcattatccacatttcacagatgaagatccttggcgttggagaggcagagactcaaagattggcttctaatattcttcctatcctcccttaagagcccagctgatgtgcttgtaaccagatctgctgagctggggagactgaagcttctttggtggctcagttgtgcgtcagccacttgctcaaatgatcagctacctccacgtaactcaatccgtgcatagttcctcctcctaccactaggcttcttttagaaaattaaatacattttttttta

SEQ ID NO: 263409 - DNA, 544 bp, Homo sapiens
ttttctagaggatctggggtactggcatttgtgtggcaataggttaacaagagaaaggcagacagaggtttattcacatgtgcattgcctatacacatgagtgtacccagagacgagttactcaaaaggctgtttaaaatttggagtttgtatacctaacttggtagaagaaagagagggaaaagtcagggcacttatggtaagcaaatgactttttgtaaaaataaatgggtctttaggataatagattggagataggctactttgtgacagtgtctctctgggtgtggtgctgacttctgtctccagtaagagagattagagttgctcctggggagggtttttttgacaattgagttcttttaggaggctctgcttttaggcagataaggatttcagaaactgaaatgccttcagcacaaaataattcttatgccaaagtgtaatattttaggatctcagcccaagagttcaaggttgcagtgagctgtgatcacgccattgcattccaccctgggtgacagaagaagaccctgtgtcttta

SEQ ID NO: 263410 - DNA, 442 bp, Homo sapiens
attacactgtgaaataactgtctaaagcaaaattagtacattatattgtcggttttataaaatatgtaacagtaatctaaaagatgggaggaaggatttaacatctgttaaagatgtatattgtaaactgagggcaatcgctaagaaattaaaaagaaatgtaacttatctaccaatagtggctattaaatggaatgctcaatctaaaagcaggctgagagctgggcatagtggctcatacctgtaatcccaacacttggggaggtgggaggattgcttgagggcaggagttccagaccagctggggcaacatagcaagactctgtctctccaaaaaaaaaaccaggtatagtcttagctacttgggcagctgacatgggaggatctcagcccaagagttcaaggttgcagtgagctgtgatcacgccattgcattccaccc

SEQ ID NO: 263411 - DNA, 486 bp, Homo sapiens
aaagaattgaaaagatgtttcacaaaagaagaagtctaaatagtcagttggcacctgaaaatgtgcccattatgcctcatcagaaaatcaaattaaaatcacaatgaaacaccactatataccaccctagaatagctcaaattaaatagactgataacactaagtcttgatgaacatgtagaggaattggaactctttcattcattgctagcaggaatgaaatatggaataaccactttggaaaacaggcagttatttttaaaagttaaatatatacttaccctatgatctcttctaccctatcatctaaggtatttgctcaagaaaaatgaaaatatgcatccacacaaagacttacaaaacaatattcaaagctgctttttaaaatgttcatatttataataatatccccaacctggaaacaacccaaatgttcatcaacagaataatgatatattcatagaatggaacactactcagcagttt

SEQ ID NO: 263412 - DNA, 408 bp, Homo sapiens
gacaataagactgggcactgtgctattaattttcttttacaaataagaaaataggcttagaacggtcaaatcatttaatttaacccagatctctttaccctctagttttacgatgaaatttgaacacaaatttgcccaattgtccctctatcccgccaaaaatcttactgctgtcctctggcttcaaaagggtaagggaaagggggagactcagttcctgctgagggcacctcatagggcatcactttctaagaatgtgtttgccccatgtgcttagcaatcacattttcactttataaaagttagctctgagagctctccttctagacagcgacactctcaagaaatcctgttcagatgtgcattgggctaatgagaaaagatataagcagttttagctgtagaaga

SEQ ID NO: 263413 - DNA, 482 bp, Homo sapiens
ctccacgcaggccactcaggacagctgaggccacgcattctctaagcagggctcaaggcaagtttgttgctaccagaagacacatctgaggctgttattttgaagggctatttaggatggctgagatgtcaccaggatcatggctcctggagagaaggaaccagctcgggcctgagaggcaatgcccacgctggagggagaagtgggtttcagggagaaggtggacgtggacagaaaccaaccacggacataatgcagccagctgcacaactcgctgcttccgggtcaccctcgttagcctcaaatccgagtgattgaaagagctccaaacactgaagcactccaaagtgatgcgcggggccaggcgtggtggctcacgcctgtaatcccagcactttgggaggctgaggcaggcagatcactcgagcccaggagttcaagaccagtatgtgaaacatagcgagaccctatgtctttaaaaa

SEQ ID NO: 263414 - DNA, 432 bp, Homo sapiens
aacatcttatgcatgcacatctcctttgccacccacaactcggaaagcagaacagaaaaacacccactaaagcatgttcagaaggtgccctccctctaccccaagcaaggtgctagctccttgtaggtgggtgaagtggctaagagcaaatatgcagggagtcaaagccccgttcaccacctaagagcggggtaatctctgtgtctccatttcctttcccgtaaaaatggagatattaagaatatctaatttacagattggaaagattgaaagagataatataagcaaagtgctgattcctagaaagctcaaaaaattcctggcatggtggctcacacctgtaatcccagtactttggaaggccgaggcaggaggattgcttgaggccaggagttggagacaagcctgggcaacatagggacaaccaaaaaa

SEQ ID NO: 263415 - DNA, 759 bp, Homo sapiens
tttctattacctgctcaactccttctgtgcatagctcctgactgccgagctgggaagaactccagtcctttcctaggctagggattttaacaacggaacaaaatcccagttcaaggtgacaaggggaaccactaaggtttcacaaggcacagtttgtgaacaactgattggagccagcctcatcaggctagatgtacctatagcaaccagcatggatctcaaaaacatagtaccaaacgaaataagacagactgagattccgggggtacacatgcatgtttgttacatgggtatattgtgcaatggtagagattggacttctagtatgcatgtcacctgaatattgaacattgtatccagcaggtaatttttcactcttcatcttcctctcaccctcttttttgtggagtccacagtgtctactgtttccaactttctgtccgtgtgtactcattgtttagctcccacttataagtgagaacatgtgatatttggttttctgctactgagttagttcacttaggatcacagcctccagcttcactcatgttgttgcagagggcatgatttcattccttttatggccgtgtgctattgtatggtatatatgtaccacatattctttattcaatcgaccactgatggacacataggttggttcatgactttgctattgttaatggtattacaacaaacataggaatgcggggggttttttttatataattgaattaatttttatatatggtatgaggtaca

SEQ ID NO: 263416 - DNA, 441 bp, Homo sapiens
tttctattacctgctcaactccttctgtgcatagctcctgactgccgagctgggaagaactccagtcctttcctaggctagggattttaacaacggaacaaaatcccagttcaaggtgacaaggggaaccactaaggtttcacaaggcacagtttgtgaacaactgattggagccagcctcatcaggctagatgtacctatagcaaccagcatggatctcaaaaacatagtaccaaacgaaataagacagactgaggtaatagaagattactatcttctttacctgaactatggtggccagaacacggcaatacatattctgcaagaagacatctacacaaaagatacacactcaacagaaagggtgccgtggtggggagaagggggtgaggcagagacattaaagggagtgagttattaaaatgtatttaatcaatgaaa

SEQ ID NO: 263417 - DNA, 2120 bp, Homo sapiens
  misc_feature (1224)..(1224): n is a, c, g, or t
  misc_feature (1274)..(1274): n is a, c, g, or t
  misc_feature (1355)..(1355): n is a, c, g, or t
gagaacatgggccacacaacagcaagtgaacagaacagagcctttattgagacaggtccgaaaggactggagcaatcagcttacagggaacatttttgcttcgtaggaatgcggtcctgcttgctgaaaacatatcctttgtacagagaacacacataatcctaggtcaactttgccctttgaagaaaaatatgctcagctggaattttggaggtggggggctggggaatgggaggtggggaggaatctattctacagaatatctgttctacagaatatctgcttagagctagaaccttcaaaggagttaagtttttggagttctgttctataaagtgtgtgggatcaaccaatacaatgcaacagccatgaaagtgatgatgaaattttatttaagagaacatctaaattatgtttaaagttcttgttggaactatcttttgcaaagatagttccagaccttggaaagcccaggcgtgatacagacaaaagtttatcaggcccctctccctctctgcacccagctgtactatttggtggtgctatgtgttcttaaggtcatgtcaatatttccattaaaacacacatttttaaaatggagatttattactctgacaggatagtttgctctggggcataagttaacttactgggtctacacttggtggggggatactttctctaccaaatttctgaggaaaaatcagaattgatttgggaattattgtactgtgctacttgattttcaaaaaatatccattgagcagaatggactaaaatattgcaaagtaatatggtttaggtgataatttataatcttatgatttaaatgagatgctgtatttgaaagcacttattttcatgcctggtatacagtaggcattcaataaatactactttggtcctatgattactactatgattactcccgtcaccaccaccaccactactaatttctttgagttgggttaatatggagtaatagatcacatactttattcatcagaaagctgggaggcgccaggtgcccacatgttaaatattaactgtgctaaattcgatcatgtagaagtttgtggccaatagtattatattaaaataaatttggtactgtaagcaacttggacaaaagttgtggaaccgaggcagaaactcactcttgagtggtcagtttcttgcacactgggttatgtgtcactggcattttagggcattttcactttncatctgcctttgtttggtgagaaactttgcagttttctgggctgcagggngcattggagggactgagaggacactcgactttggagctggggatggggaggcctcgttacaagccttgctttgctaccagnggatttagaaaaggttacattgccactctgggcctcaggctcccatttctaggaggtaaagtagtctatggctgtcttactctgacgtttgggctctcccaggccatatctgtgaagcaacagctggtggtctggcttcactgaccctcctgctctcaagacatggccattgtagacatgtactcattcgggatcagaaaggaatggaagcaggtggccagggaacttcgaggcattgaagtggagtccatttttcggtcctgagggctcctagcctgagaaagcttgacctgtgggtcagtgaagcccttgcttgagccagcagagagttaggacctctgattctcaaaacataacttcactgctccgctcacacaattgcagtcaaggaattgaggactagaggtttcagtccctactgcacttccagcaatggactgggaaaatcaggctcaagtcattgatactggtaaataaaagggccttatttcacctgtaatcccagcaatttgggaggtcaaggcaggaggatcgcttgaggccaggagttcaaggtcagtctgggcaacatagcaaaacctcatctctacaaaaaatttaaaaaatttagccaggcatggtggcatacacctggggtctcagctgcttgggaggctgaggcaggaggattgcttgagcccaggagtttgagactgcagtgagctatgatcacaccactgcactccacactccagcctggggaacagagtaagaccctgtatctta

SEQ ID NO: 263418 - DNA, 508 bp, Homo sapiens
agattgattttattttgaaggtcctttcaaatgtttgctaacaatgtattctctttaaatgtttggagaaaattataagtgatttataagatttatcttataaaatttttataaacaatgtaattcagacatgagattatactatcccattcatcttaacctttcttgatttgagaaaaattatataaacattttaagcataaatttgacttaaaattaaattaaaaagttgtatattttattgttatcatatgaaaaatctaactcatgctatttgtggatgaagcctaatttttatatttaaattgttataactatgtacatttttttcttaggtcttcttttcaaattcatttttcaacttaaatattgagatgctgatgcacacaacttgtacttgcatgtattatgtaaataatgaaatgcaatattttatctttttattggattccagatatagataaataatttttgtatacttaagaataaagaaaatattcccccccaa

SEQ ID NO: 263419 - DNA, 296 bp, Homo sapiens
gtgggagggtgtgtggggtttgtgtgaagctgtgccaacctgtgggtgtgcaaccatgcaccctctccactttccccacacctgagtggtctgctggtcaccgtcagtagaccatgcatgcaaaatcattcttctggacgtgcaggagaaactgaaaaccagcactgtcaggtgtgttaaaacccttaagattggttctcggctgggcgcggtggctcactcctgtaatcccaacactttgggaggccgaggcgggcggatcatgaggtcaggagatccagaccatggtgaaaccc

SEQ ID NO: 263420 - DNA, 197 bp, Homo sapiens
gttttgtttcctgtgagcatcattctcacttcctaggggtgtctgttttagaaatatcatgtctaaaatgttcagaaggccgggcgcggtggctcatgcctgtcatcccaacactttgggaggccgaggcgggtggatcacctgagatcaggagttcaagaccagcctaaccaatatggtgaaaccctgtctctact

SEQ ID NO: 263421 - DNA, 111 bp, Homo sapiens
gagggtggcagcccagagccatggctctcgcgagtggtttatgtggcacttgaggctacaagtccaagtatcttcagctcaagaagaagttagaagatgagttcccccggc

SEQ ID NO: 263422 - DNA, 486 bp, Homo sapiens
gaaaccctatgaatgtactgaatgtgggaaaacctacactcacaaatcaagtctcaatgaacattgtagaatatagggcaaaagctctgtgaatgtaataaatgtgacacatcattgtgccacagttcagtccttactaaatgtcagagaattcaaagaggaaagaagcactgtaagtataatgaatgtaagaaatccttttgctagaagacaaactctgtggtacatcagatagcacacatagcggaaaatgtcttttaaatgttgaaaatgtcttaaatattgaaactccaaaattaaatccataaaccaaactcattatatatgagagaactgatgaaatgcagccgtgaacatcaaataatcataatcaacaaatcaataaaaaaaaccttgtatatataagcataattacttgtacatcaaattattagtctaggatttaaaccttatggacagttggtattaacatttgacaagatttaa

SEQ ID NO: 263423 - DNA, 340 bp, Homo sapiens
ctgtcacccaggctggagtgcaatggcgctatctcatctcactgcaacctctgcctcccgggttcaagtgattctcctgcctcagcctcccaagtagctgggattacagacatccaccactgcgcctggctaatttttgtatttttagtagagacggggtttcaccgttttggccaggttggtctcaaactcctgacctcaagtgatccacctgccttggcctcccaaagtgctgggattgcaggtgtgagccaccacacccagcctgaagcctcttttataagggcattaatccatccatgagacagaaccctcatgacttaatcactttctaaaaggc

SEQ ID NO: 263424 - DNA, 638 bp, Homo sapiens
agatcaaagaatatttggcaactcagcttcattcagtataggtcactgtcaattcaaagtttgggtcaactagttggttgcataatatgaacctctcccaactcagaataatactgaattcagggtctctggtaggtataatcatgtcagtgattttagccctacatagaagtatatcagcattttcttctcttgctgatcaagcatcctcagaatccattcccatacataatcctacataaccgtcatgtttctgcagtacatatgtggttggtagagtaatggcatctcaaaggtgcccacatcctggtctcggaacctgtgaatatgttatctaacttgattaaagggactttgcagctgtgatatcaggttcatgatcttgaggtggggagattatcctggattatgtgggtaggtccagtgtcattgcaaaggtcttcataagagggaatcaggagggtcacagggagagacggaatgtgatggggaagcagaggttggagtggtttggggtcatgagccaatccggtaacctctggaagctggaaaaggcgaggaaacttgttctcccctagagcctccagaaggaaccatccctgctgaccccttttagacttccagaactctaagactat

SEQ ID NO: 263425 - DNA, 381 bp, Homo sapiens
agagcaatggtactgaattaagaaattctggttgagaatacagtggaactttagtgtcccatggacaacccttcaacatttcttatttatttatgaactcaaaatcagtcccgtatattcggagaagacagaaataatggcagagatcttttccacctcagttggcttgattttctaggcatagatatactatcgcttaggatcatagaaagagcactggggcaagggtcaggggagctgaatcctagtcgttggtttgacacttacaggatgtggggttagcgtctatgttcctatctgtaagtgcttgtcctttcttagagttgtgactctaaggattttatttttattttatttcaacagaattatataaagttttaa

SEQ ID NO: 263426 - DNA, 517 bp, Homo sapiens
ctgggaagatagagaaggtctcaaggtctgtatttcacaagtagaaccaggatgggaggagcaagggaaggtggaagtacgcaacaaagaggtggacaaacactgaaggggaaaggagaaagggagaaggactgactccatctcgtcagctccactttggggaagtatagaatgagagagactgcaaagcccctagaaggatgtctagtaacccgggctctgtctggaggacgtcctacagcgagaaagattttgactatcacatcataatgtgcatgtctctgaggagaagaatatatttatattcattatcacacaggcctttgttctgtgtaattatttgctgaatgtttaaattaaatgctgcttttccagctgggtgtgcttgtagtcccagctactcttgaggctgaggcgacaggattgcttgaggcccgcagttgaactgaaaagccagcctgccagcctgagcaacatagtgagaccccatctcttaaaaaaaaaaaaaaaaagaaag

SEQ ID NO: 263427 - DNA, 196 bp, Homo sapiens
aaagagatgtataagcacccagacaggaaatgaggataagtgtttattaaacacaagttatttcatactagcctcatcctctttttggaaaccattattaaactggtagagtatggaaatccctagatgtcagatacccggactatttaaagttatgttttaatcatgtaataaaggaatgcattctcatataaat

SEQ ID NO: 263428 - DNA, 374 bp, Homo sapiens
gcaacttcctctgtacctttaaagacaaatatctccaacacctatcacggtatatgttgttaatgatgttaaaattgtgtccaaattaacagaaggccaaatttaacattgaagtccaaatttcttggctaataatgcaagtaaaaaaaatagatgataccttttggctgatctgaatacactgataactggctggacgcggtggatcatgcctgtaatcccagcactttgagaggccgaggcgggcggatcacctgaggtcaggagttggagaccagcctggccaacatggtgaaacccgtctctactaaagtacaaaaattagctaggtgtggtggcacatgcctgtaatcccagctactcaggtggctgag

SEQ ID NO: 263429 - DNA, 263 bp, Homo sapiens
cacaaaatgatcaaagagcatgaacgtacaatttatgagataaaaaagaaccgaaagtcatacgaaaaataaatgtttaacagcagtagtaatcaattaaatgcaaattaaaacaatagggagtggtttgtgaaagttaatgcctggtgcaggagagagtcatgagaagtagctgactccttcactcatggtgtaaggggaaattgggacaaactttctagaaggaaatttggaaatgtgggttagaagcctttagcctggcc

SEQ ID NO: 263430 - DNA, 292 bp, Homo sapiens
ctctcagaatctaagacttgacgtcagaaaaattgttgctactaatctatgtagagatattacaactttatggaattgtgtttaattaaaattattatttttaaaacttcttcattttaacttccatataaaattagaaatgttttcccaaaatcaggcatggtggtgcatgcctgtagtcccagctactctggaggctaaggcaggagaatcgcttgagcccaggagttctaatccagcctgggcaacataatgagacaccccccctcccgccccgcctccatctctttta

SEQ ID NO: 263431 - DNA, 390 bp, Homo sapiens
acttattaaatagtcaaaagaattatgtatttatccctaaattattttcttatatagttctgagaggtggaaaggagtatagaagttgtcatatacaagctcttcagttacagttgagaaagtgaaagttgatttgtaattggaacagaagggactatccacaatcttatttttatttatctcagttgtacaatgaacagcaacaacaaaaaattatctttcaatgataccagagcttgagaagacctgcagaactatccagccctctaactctgcagatgagaacacggaagcctgaaagggttagggcagtggtgggagggggcccggattttcttcctcctcatccaatcctgtcttcatctcactaaatataacatccagatgaag

SEQ ID NO: 263432 - DNA, 755 bp, Homo sapiens
tacaggtcctggggtccaggagacccagaatgaaggtgtcagttgggcatgaagtgttatttagtgtccattcttgatccttctgagcacctacagctggaaactaagcagatactggtcctgcattctgactgagattgtgtcttctttatgaggatagatcaaattggcagtcaggcccatgatagtcagtgcagttggggcagttgtagactttgctacaggatttcagggtttccaatcaccccacaggtaagtgaatgccaaagtcttcttttttcagaccatacaagaagtcattttgattttcaaagaagccgttttgattttcaaagaagcaggttctggtgacattattttcttccttggacaaagtggggggaaatttctaagtattttaactgagttcagggtccttagtgagcctggacagagcaaggagagggctccccactccctaagccccacagccagctctgcatcaccacacacagccagagcctgtgaggagctgccttcttccccatgtgacttgcaaagagtctcaggcaagaaaccagggcttcaaactgctagttcccatggagggtagttccctcgtgtggagcacttgtgttaggatcactgattatctgacaaaggctggtgcagaaaaaaaattgtaggcccaagtgtcaagaaccacaccagattggagatagaaaagaatagctgaaattatgtcagtggtgaaatgtcactccattgacccaccg

SEQ ID NO: 263433 - DNA, 237 bp, Homo sapiens
acaggatgttccttttcccggggcacggggaagacaccactcacaggagtgacttataatctgcttcactccaatcttcctgcatctgccattttctcaaattacattagtttaaaatattcaatatgtaggctgggtgcaatgactcatgcctataatgccaacactttgggaggctgaagtgggaggaatgcttgagcccaggagtttgagaccacctgggagacatagcaaggc

SEQ ID NO: 263434 - DNA, 562 bp, Homo sapiens
aatgtatgctaaatgtccctgggaagtctggccatggaaaatgactgttctgaattcctccaacccttttaactcaagctgaccagctgatccagactaaacagtgagaacataggaaacagcaaagattgaagaatgacctttttgttgtcatgacttatggaatagtcagatgtaattagcctagcatactattgaaaggtacaatagtgtatggaatatacctgatgctacaggaggaaatggaaagaaataagctatacctctccagcagaggaactagagaaaagattatcagtcagtgctgaagaatctcattggccccacttccaaggtagtggttatttaggatgcagtgggttaagacaagtatagtttagccttaagtggctacctgtaatgctaagtaaaaccatctctagtcattggtaccgaagtacagaaaaaacacacagacctataggcaagcatagggctctcatctggtaagctgagattaatggttcaggttttggcccatcagactataccaaatgaggggttaagaatcctgaacacaccc

SEQ ID NO: 263435 - DNA, 515 bp, Homo sapiens
cacatctactggggaatgacagagagaggctctgacagaggaagacccaggccacgggctaccacaatctaagcttcagggacaaccatcaaacacagggaggggctggcctagggtgaggcccagagtgcctttcttctgttctgagtagagactcaaggatatagcgatcaagggaggaggctggagaatggggactttcatgtaaacagcagatcctacaccaatcatcattagcaacaaacctttactaagggcaaaatatatacaactgtgatgctgtgcatctcccccatctgtaaaataggggagagaatacctcctagagttactgtgaagattaagttcttttcactgtatcgaataccgataaacacttaatatttcttaggctattaatattttaattttttggactagaggttattataaaacattttttgtttttaccttaagaataaaaaactcttgaaaatactggcacctgacaataaaaggaaagaatatgatactgc

SEQ ID NO: 263436 - DNA, 310 bp, Homo sapiens
gaagtgcccaaacaaatagagatactcagttacacagcacatagtaggaactttataaatacctgttgaatgaatatggttggggtctaggctgcagctcagcagggatggcagcccaaggtgacaaagtacgagtcttcacacacgaggatggacagcgtggagctcttgggttcagaagacgctccttggccaggtgcagtggctcacacctgtaatcccagcactttaggaggccgaggtgggaggattgcttgagcccaggagcttaagaccagtcttgggcaacatggaataaaccctacgtcta

SEQ ID NO: 263437 - DNA, 317 bp, Homo sapiens
ggggataataatatctatagtataggcttgtaagaatgacataagatcatttttgcaaagtacattgtagatacagataaatgtatctgtatctacaatatactttagccagtggtgatggagagcctggggtcagaatacttaggttcaaatgattttagccatattatttaacctctctgtgccttagtttccttatttgtagaatggggctataaccatacctacctcagagggtcattgtaaggagtaagtaaagtaacccaggtgaaggctacacatagtaagtgctcaataaatactagctattttatata

SEQ ID NO: 263438 - DNA, 496 bp, Homo sapiens
tctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaa

SEQ ID NO: 263439 - DNA, 398 bp, Homo sapiens
cctttatttatttatttatttttattatcttaaccagtttacatctgcaaagaccctatttccaaataatgtagatggcagatgagacttgagcatatattttgtggggggccatagtctaacccataacaccaggtctccacctacattaaagtgtatctgtgaggatgtttagttgtacatgcatccgggcttgccatcacagaggtccgtgtggtggccctgtggagcacacctccatgccctgtctgtgtggacctgtgcattgggtttatatcaaacatggaggtttctttagtacgtgtctggttcgctccccgccgtgttctaagactcctcacctgcctacagggtgctgtgctcatacgcaaaaccaagggttttcaatgactttccac

SEQ ID NO: 263440 - DNA, 910 bp, Homo sapiens
  misc_feature (5)..(5): n is a, c, g, or t
  misc_feature (906)..(906): n is a, c, g, or t
  misc_feature (908)..(908): n is a, c, g, or t
aaaanccctatcagtgtagtgaatgtggaaaaacctttagccagaagtcatacctcacaatacatcatagaactcacacaggggaaaagccctatgcatgtgaccattgtgaagaagcatttagccataagtcaaggcttactgtccatcagagaacacacacaggggaaaaaccgtatgaatgtaatgagtgtggaaaaccctttatcaataagtcgaacctcaggttacatcagagaactcacacaggggaaaaaccctatgaatgcaatgaatgtgggaaaacgtttcaccgtaagtcattcctcactatccatcaatggactcacacaggggaaaaaccctacgaatgcaatgaatgtgggaaaacctttcgctgtaagtcattcctcactgtccatcagagaactcatgctggggaaaaaccatacgcatgtaacgaatgtggaaaaacatatagccacaagtcataccttacagtacatcacagaactcacacaggggaaaaaccctatgaatgtaatgaatgtggaaaatcctttcactgtaagtcattcctaactatacatcagagaactcatgctggcaaaaaaccctatgaatgtaatgaatgtgagaaaacctttatcaataagttaaaccttgggatacacaagataactcacacaggggaaagaccctatgaatgtaatgaatgtggaaaaacctttcgtcagaagtcaaatctcagcacccatcagggaactcacacaggagagaaaccttacgtatgtggaaaaacctttcatcgcaagtcattcctcaccatacaccagagaactcacacggggaaaaaccatatggatgtaatgaatgtggaaaaactttttgtcagaaatcataccttattatacatcagagaactcncncc

SEQ ID NO: 263441 - DNA, 364 bp, Homo sapiens
tcacgcctgtaatcccagcactttgggaggccgaggcgggcagatcacggggtcaggagatcgagaccatcctgactaacacggtgaaaccctgtctctactaaaaatacaaaaaattagccaggcttggtggcgggcgcctgtagtcccagctactcggcaggctgaggcaggagaatggcatgaatccaggaggcggagctggcagtgagccgagatcgtgccaccacactccagcctgggcaacagagcgagactctgtcaaacagagagagagagagagaaagaaaaagaaatcaatcaatcaatcaatccggtttagatgacaacatgaatcaggtttgttgttgttgttgttgtttcc

SEQ ID NO: 263442 - DNA, 400 bp, Homo sapiens
acctgagtgagttttcgcatccataatgtggggacgatggaatctattcttacaactttagaaggtagatttaataatacatcatgaattcgtacaatgtgtaatgtttattaaatgttgactgtgattagtggttgtccagctttaaaggtgtgggagcgggattgattacaagggaacatcagagagcttttttgggttatggaaatgttttgtgtcttgattgtagtgttggttgcttgactggacatatttgttcgcacttatcaaacccttgaagttgatggattttttgcatataagttatacctcaacaaagctgattttataaagataactgcctttcccttttctgtgtactccagttacatcaactgttaataaaatagagttgatacca

SEQ ID NO: 263443 - DNA, 455 bp, Homo sapiens
acgagcgtccccaggaagacaccttgcttgtctctaattccatgaactttttgcaagaaaatcttgcttgccttccccaggggtcaggtcttcagaggggagactcctgccctggtgtgcccggctcctgcccatccagcagagcaggaaaaggtgactcgggttccatttgacaaacgtctcttctgaaagctgcccttagcaggcaggagaaaagcccccatttactggggccttgtcagagtttctagagcttaaattctcttcttcagaaaggaaaaatatctgcggccccacatccgcagatgcataaacgtgggcgtgatttatgagtgcacgtggtatccagcgctttcccccagctactgtgaaatcgttcctcttctctgactgagacgtcaacagtatggtcactgtatatgttttcccactttttccagagccaagaaccagga

SEQ ID NO: 263444 - DNA, 196 bp, Homo sapiens
ttcaccatgttggccaggctggtctcgaacccctgacctcaggtgatccaccctccttgaccttccaaagtgctgagattacaggtgtgagccattgcacctggccaggtgggagatttttaatgaccaggcctggaggtggcacacatcacttatacccacatccattggccagcactcagttacacggccactt

SEQ ID NO: 263445 - DNA, 350 bp, Homo sapiens
caggttatgaagatgatgggattaagaaattaaagacaggcataggaaattataagaatattgattggggaagtgataaatgtgcatgaaatcttaacaatttctgttcagagattgcagtaaagacaggcataagaaattataaaagtattaatttggggaactaataaatgtccatgaaatcttcacaatttatgttcttctgttgtggcttcagccggtccctccgttcggggtctctgacttcccggaacactgtctcagctttccaaagtgttgggattataggtgtgagccaccacacctggccaatatatgtttatcatagaaaattccaggagaaatttaca

SEQ ID NO: 263446 - DNA, 352 bp, Homo sapiens
attcctcacagggcaaattcatctaactgtgtgcttagaagctccagaatggaactcttacccaccaggaggttgccccgagagataacagtcaatttacaatccaaagtatgcccgctagagtttttggccaccattacaactcatttctgcccatgaagacaccagcttgacagcctgatagataaggcaccaagctagcacaaaacccctcacctgcttgtgtcctcctttgccttttaaaagtgcccactttctgctccaaaggtgaagcagtatacttaaggacggaagcctgtacttcttcccctaagctagttttggaataaaaaggcactttctttataccaga

SEQ ID NO: 263447 - DNA, 304 bp, Homo sapiens
actaaaagtacaaaaattagccaggcgtggtggctgacacctgtaatcccagctacccgggaggctgaggcatgagaatcacatgaacccaggaggtggagattgcagtgagccgagatcgcaccactgcactccagcctgggggatagaacgagactctgtctcaaaaaaaaaaaaagcctttaatatgttttaactaacatatatgagtgaatcctaataaaagagttatggcttatgtttttgtttgttcagtaacacgtaagcatccatacattgaacatgtattgagagcctaccactg

SEQ ID NO: 263448 - DNA, 367 bp, Homo sapiens
aataaaatgatagctttcctgtttgagggatgcccaaattctttgcaaaatctaattacaagtctgaataggcagtaaaatttgttcttgctatttatataattgtaaactttaactcagaaatggacattataagctgttctcagagtatccaaagatcaggttggcaccaacaggtcccgagtaagtcaggttttcttcacccctccctgtgtccctctggggaccgagcacgtccagggagcaaggagcagaccagtcagcaaaatgtaaaacctgtcttaacctggaaggtggggctgtcttatccacatttggctccacctctgagctaacttctgattaaagctgatctaaggaaaggact

SEQ ID NO: 263449 - DNA, 465 bp, Homo sapiens
gcgagaccgcccgggggagatctgcgcaggcgcggagctgccgcggtcataggagggcgcgagcagcttggctggctagggcttgtagagttgccctggtaccctagtattcctaattgcaaaatctttatgaagcttaagaaaaaaatcaccagcctgggcaacctggggaggccccgtctctacaaaaaaattaaaaaattagccgagtgtggtggcgtgcacctgtggtccagctactatggaggctgaggcaggaggattgcttaggtccaggagttcgaggctgcaatgagctatgaacgtgccactacactccaccctgagccacagagcaagaccctgtttcaaataaaatttaaaaaaagttactgaaatacagatgtgcaattttattccttagcctagtctcacctctgctgcatgtgactattgttcacatattaattccaccacaatttaagg

SEQ ID NO: 263450 - DNA, 320 bp, Homo sapiens
gaggattaagaaaaataatgggtactaggattaatcctgggtgatgaaataatctgtacaacaaacccccttgactcatgcttacctatgtaacaaacctgcacatgtacctctgaactcaaaagttgaaaaataaactatatccacactagtacacaaatggaggcatgctctgtcatacatcctgctgcatttaatgtataagaaagaaccattggtccttgttgctcacttctgtgaacaaaaagtgcactaaggccatgggagtcatccactttcaggtcaaggtctatcctttcccttgtggtaaataccaggcc

SEQ ID NO: 263451 - DNA, 2470 bp, Homo sapiens
tttataggattgacttaaaagtaagcatttattcagttataagaaaaccaggtaatttatttatttacttatttattttttctgagatggagtttcactcttgttgcccaggctggagtgcaatggcatgatctcgcctcactgcaacctccgcctctcgggttcaagtgattctcctgcctcagcctactgagtagctgggattacaggcatgtaccaccatgcccagctaattttgtatttttagtagagatggggtttcaccatgttggttaggctggtctcgaacccccgacctcaggtgatccacctgccttggcctcccaaagtgctgggattacaggcatgagccaccgcacccggctcaaatcatttaatttaaggattgcagcttaagacttggcatacggatacttggatgacactgatttcttctgtagctgggcaaatcagtttcctcaccaaaagtgaatatggtaaaattacatgtttatatcatatgattgtgagactcaataatagtttgagagctcagtattatctttgtaggaaagacataatttccaaatttgattagaatttgaaaataaatcacattttgatcattgctagatactgtgtctaaatgtggaaaaacctttgagaaggatttttgtatttttttttgactatttcaagtcaatagagaaaagaattctgttgaaatcagtgaagtggtgataagtagtgggtggaagattacagctcagacttaatgggatagatttggaatattatagatgggtgaatttattacaaagcaaatattaccccaaattgtcctctaagaaaatcctcccccaatctgttaatgaaaaaaaaattgtggtacaatccttataaaatttaccattttagccattttaaagtcttaatgccagttcagtggcattaagtacattcattttgctttgttactatcactgccatccatctccagaaagcttttcatcttgaaaatctgttaccgtacttatttaacaataagtccttatatccctctctcctcagcccctggcaaccaccatcctactttctatctctgaattcgactcttctattaataggtacctcatataagtggaacatagagtatttgcccttttttgtgactggcttatttcacttagcataatgtgcccaagagtcatatatgttagcatgcgtcaggattttatttcttttaaaggctaaataatgttccattgtatgtatataccatattttgcttattctttcaccttccatggacatttaggttgtttctaccttgtaggtactgtgaatcatgcagccataaacattggtgttcaaatatatgttccagcttctgctttcaattcttttgcatatatacccagaagttaaattgctggatcacatagtcattctatttttaatttttttgaggaactgtcatattgttttctatagtggctgcaccaccaaaattttgaatggagagaatgtcagcatcctgtttaataaattattttaaaaatcagctctgagcaaatgaatttagaatttggaatatttgaccaaaaatcagttttacacgtacatagtatgttactgataaaggaatgactagagtagtacacctacagttcttgctggccagagccaggagggggtgtaaaggaatttcctgggtttaaaaaagcaggcagcattgatgaatcatgaagttccccctacctcctttaatggttttgtaacaaagagatgcattcaggtgaaagtttcaagtctttttgtaactatagaataactgttctttttgtaattgtagaattctttaactttttttaggctgaagtagagaacatgaatcatttggtctgaaacttttgagaccctatttggtttgcttacatatgtgaaaatagttatccaaataattgcgattgctatcaaataatttcaataatatcagttacttcttttggtctagagtcttctcctccttaacctctttctttttggcgagacagggtctcactctgttacccaggctggagtgcaatggagtgatcactgcccctttgaacttctgggctcaagtgatcctctcacctcagcttcctgagtaggtgggactacagatgtgtgccaccaagcctggctaattaaaaacaaatgtttaagccaggcatggtggctcacacctgtaatttcagcaccttgggaggccgaggcaggcggatcacttgaggtcaggagttcaagaccagcctggccaagatggtggaaccctgcctctactaaaaacacacacacaaattagccgggcatggtggctggtgtctgtaatcccagctgtgggaggttgaggcaggagaatcacttgaacctgggaggtggaggtttcagtgagccaagatcatttcacctcactccagcctgggtgacagcgtaagactctctc

SEQ ID NO: 263452 - DNA, 401 bp, Homo sapiens
actccttatatatccagagagcatatatattataaatatttaacctacctagtatagcttattggatactaaagcaggactttgttaaactcttagcatgcagtggatcatctactatggtcactgtatgaggtgggtgctttgccattcccagctgtagccccaaccctcagcactgggcctggcatgagttaagtactttattgatatttgttgagtaaatgaatggaggtaaaagtcagctagcaaggcagccagggtagctacaggcagcctgatttggacaagtaattttattttatttttaatttatttatttattttgaatctctgaaagagtttcacttttgtcgcccagaggttgcagtgatccaagattcgcccacggcactcaagcctgg

SEQ ID NO: 263453 - DNA, 303 bp, Homo sapiens
atcttttaggtcttccttgttcagcagttgattttaatttgcttaatgaaaactttatccacagagcagagtgttcttctagggctcctcattgaccaaagcaaactgaaagccagagatcaaggatgctactaggtggagctcatataggtcagccgctcaaaacacagggaagggtgaagaagaatggataatagatcctggatgtgaaaggaaaaaaaattgtgacactccgtttttaataagaatgtatcagttcaatcactatcagtttgcagatgtacattaaataataacaagcaa

SEQ ID NO: 263454 - DNA, 414 bp, Homo sapiens
atttttgttttcctattagggtaatggtaggatcttttagtgatttgggccaaacgacatctatttagaacatgaattgtcaaaaaatgggaaatgtccttcacagagcagagaagagataattcctgaccttaagccacttgcattattaaaagcaaagcctgggaactagcctggcattcatctggactgaggaagagtcctaatcaatctatattgctaacaatattatttggatatgtgtgtgcatgtgtgagggcatatgtgtattgattcataaaacattaagtgaataaagcaggtatgttatgctatgaccttgtttgtgcttatgtatacagtaatagatgaattagtatgttttaaggatatgttctagaatgttaatagtgatttctacactggatacagagg

SEQ ID NO: 263455 - DNA, 468 bp, Homo sapiens
attaataaatatatatgtatcaaagattataatgcataatgttaaaagctgcagtaattttcaaagaaagtagtacctagatacaagagtcctccagtaaggaaggtgagtaactacccatttgccatgaatcagcagttagcctattagtggtgcttcacaaatacttttttgtcatctttgaggggtagaagcactgctattccatagctcctagagagatgtagcggccaggatgaaactcagaagcccagggagctccagccgtaggatcccagagctcagtctctctgctcccctggaatgtgtttttccaaactgcggtgtgaggctgaagggccagcacactggacccaggcttatgaaatggacaagactaatgtgaaagggactggttctttgcgggtgctcattaaatgtggtttccccttctcttattcaataaatagctatttggtttgtgtcaaa

SEQ ID NO: 263456 - DNA, 430 bp, Homo sapiens
gggatcttatttcaaatgcacactccaactgaatgggtacaggggtctgcatctctattgatctcccaggtgatgccaatgctgatggtccatggctcccattttgggggagcaagtctccagagctcattttgtgtccccttgtacacaactctactcactggataggagaggggggtttacttatctgtaccctattcatttcagaactgcttgagggaagcacctgtgccttcctgggctctgcacccctagcaaataatgtagtttctgacacaaagtaggccctcaggagatgttgcattaaggaatgaattatggaagacagaggaaagggaagcaggctcaagttcccagcacctggggaattctaagcctgaggaagacaaggtgcacacacaatatattaataaaagataacttttaaagc

SEQ ID NO: 263457 - DNA, 307 bp, Homo sapiens
tacaagcttctgcttctcctatactggttgctgtgagacaggacatttttcctgctggtgccaccctggccccctctccctttggctattctgtttctccggttgtgagaagagctcgtcatattttgtcattggttgggaagctgtagatggtttccctctttctccttcattaatcaaacacacctgtcgctaaggttgtttcctgtctcatacataacacctcccactgtacctgaggagtgccaacggctgcctgcaggccctggggtgcagccagacctcaacctaagccttactgtttaac

SEQ ID NO: 263458 - DNA, 473 bp, Homo sapiens
tgctctagaaaaatcaagtccgggttttttaaagtctgcttggaaatctgaaacctgagagctggctcttgtgtcccccactgttctcccgtgctcccccgccctggttacatgcagagcagtggggccatgagacaaaagagaatgacccagaaggacactgtggcggttggtctcaaatgcctgccccagccacacctgtctctccattgactttcgtgccacctaggaggaaggcggtgccacccatttcacaggtcagaaaacccagactcacggaggtgccacaactggccctacggtgacactgtaaatggtggagctttcagtccaacctgggtaggtctgaatgcaaagccaaggtccaaatactgcactgtcttcttggggacatgaattgccacagaattcgccttgtgctttaatgcctgtctcgtgtttctctgtgattaaaaaaaattcatgtgaagttc

SEQ ID NO: 263459 - DNA, 238 bp, Homo sapiens
ttttttttttgtgagctgctattttttcctgcaatgcactgttctttggtttgggaaatgtgctatatttgtaccgtgctttaaacatacacaatggttctaaataactacttttctttaaagttagatgtaacatcttaattaaaatgtcatccataaatcaggcacagtctgtgaggttgtgcgagcgtgaaagctccacagtctgaggcctggagaccccttctgtcgtcttctc

SEQ ID NO: 263460 - DNA, 670 bp, Homo sapiens
gcatcaaggctgcagtgagccatgattgtgccagtgcattccagcctgggtgacagatcaagaccctgtctgttaacaaaaaaaaagtatacacagatgtttgactgcgtgggagttggcaccctaccaacttgttcaaggatcaacattattcaaggatcaactgtagttatactatattgtttaggaaatacaagggaacaaagtcggtacgtgttcagtacagatacaatttttaaaaaaattcttgatctgcagttggttgaatccacagacgtgtagtgcacaaatacggagggccgactgtatttgtagtcaccctgatagtttgtgacacagccattgcttttttaaaaagtgtggttagttctctgtgacttcctcacttctatcctaatagtacttctgtgctactcctctggctcatgccacctgttgctttgccatagaaacagtccatcttcaggttggtgatatctgcttagatttccctgtatctttgctgccctccttcaagtttttgtacaagttagtatgtacagtgtcatacataaaataaaaattccacagcatgttttacttaattaaccttcattaaagaaagttgtaaaagaaaaaagaaaaatccagcaggtcatggacaacttaaaaagaaagtttggaaaaaaaa

SEQ ID NO: 263461 - DNA, 623 bp, Homo sapiens
ctccaaccaggccatcccccttcgtgaacctgatcttgtcagagtcacaaggacctccacgatctccacattgctaaccaaatggtcaatgttcagtcttcatcttattcagctcatcagcagtccataacttcctcttccttgatgcatattcttcacctagcttccaaaacctatacttctcctggcttttctctgccttaccggtaatgccttactggtctcgttgctggctccttctcttctgccccactttatgcacagaaatgccctagacctgccctttctctacctatactcaccctctactgcttgtgagcatcttgcggtcagctctccacctacccagccccctgcagtttgagctcaatacctgtttgttgaagtgcactgagtccggaaagtcggttctgtcagtgagcttctacagaaaggaagcctttgaaaattttttttgagaaaagaagacggggcaagaaggggggccggaataaaacactgcactcacttcactatttaccctcttatctgttatctgtagagaggaggcaacactgaggagcacagtgattctcagacttagagcacacccaaattattaaaatcacttgttaaaatgcggg

SEQ ID NO: 263462 - DNA, 250 bp, Homo sapiens
agccctttctcattcatgtgctgggtattcagcgaggctttcaatccagaaactcgtacttcttagttccagaaattttgcttaaattattcctgtatgttctttctgtagtattcacttcctagagcatctattaaatagaagttggacatcctggattgattctgtaagttttccttgtgtcctattatccaccaacttgtcttttcttccccactgtctaggagtgttcattaaaagaaaaaaactc

SEQ ID NO: 263463 - DNA, 432 bp, Homo sapiens
ctgtgctctccctagctcccggtcccttcctggcccagagcaggccctctgcaaacatctgcagaatgacggctgggcgtggggctttctcaggcccctgcccttctctctcagacctctcctggagcactcatccccttttgtgccttccaccattttctctgtttaactcatctctctgtaaatgcaagtcctgatatccaagagcctgcagattttttttttttgagaccaagtctcgctctgttgcccaggctggagtgcagtggctcaatctcggctcactacaacctccatccctgggctcaagagactctcttgcctcagcctcccaagcagattgaattacaggtgtgcgctgccatgcccggctaataatttttttttttttagacggagtctcgctttgtcacccaggctggagtgcagtgg

SEQ ID NO: 263464 - DNA, 387 bp, Homo sapiens
cactattatagtctcaaattttcggataaggagatgctcacagagaataacctactcagctagtgagggacagtgcccagtgagaacccaggccgtccagctctggcatgcctggccactataccatattgcctctttatattcttttgcaggattgctttcattttaatatgtagcaagaggactatagtatttagcaaaattggattagcgttgaaagctatattacattaaaaaattatgatttttagactttaagccttggctaataagtaaataaatcaatttcctaacatctgatactttttctgaatgaaatggttgaatttataaccttgatgttcttgccacataatggattacattaaaaatatataatcttcttta

SEQ ID NO: 263465 - DNA, 400 bp, Homo sapiens
aaatacagcattcccccatacacctgctgtgatacctgaaattgccatcaatagagtgatttctttgtgttaaggaggtataatactgagttcatcattataagtcagtcgtaggcctggcacggtggctcacacctgtaatcccagcactttgggaggctgaggctggcagatcacctgaggtcaggagttcgagaccagcctgaccaacatggagaaaccccgtctctactaaaaaaaaataccaagttagccgggcatggtggcacatgcctgtaatcccagctactcaggaggctgaggcagaagaattgcttgaacctgggaggcggaggttgcggtgagccgagatcccaccgttgcactccagcctgggcaacaagagtgaaactctgtctca

SEQ ID NO: 263466 - DNA, 410 bp, Homo sapiens
actttatgagcttgacagttggtgaaaacttttctgtttaaaattttatttggccctccccaaaagaaatgtttatttatgagtattaggatagttccagcagtaatgcctcaaaagaaccaggaggtatagtgttgtctaaaatgtggactcaggagccagactgcctggctgtgcaactagccttgtcacttcctagatatgtggcaagttaattaacttctcagtgttcttatctgtagaatggggataatcctaatatacatctcagggttatattacaaattaaaaaagttaattttgtaaaggacttagaatgatatctggcaaataaaagtgttcataaaagtaaaccctataaaagtgtttactcattaaatacaataatctgaaaccattagtaatttaaa

SEQ ID NO: 263467 - DNA, 394 bp, Homo sapiens
ttttttttttgagaaggaatctcactctgttgccaggctggagtacatcagcgtgatctcggctcactgtaatctctgcctcccgggttcaagcaattctcctgcctcagcctcccaagtagctgggactacgggcacacacaacgcccagctaatttttgtatttgtagtagagacagggtttcaccatgttggccaggatggtctcaatctcttgacctcatgatccgcccaccttggcctcccaaagtgctgggattacaggcatgagccaccacacccagccagcatttctaacaatcttaagagatgttcatccaggggttactctgtgagactccctggtaagcattatctcttcagccttgaacacccctacacaacctggccatac

SEQ ID NO: 263468 - DNA, 1145 bp, Homo sapiens
tgcgctggcaacctactcgggttcccttccatggtgtggaagcttagttcttttgctattcacagtaaatcttgctgttcctcgctctttgggtccgcactacctttctgagctgtaacactcactgcgaaggtctgaggcttcactcctgaagttagcaagaccgcaaacccaccaggaggaacaaacgattctggacgtgccacctttaagagctgtaacactcactgccaaggtctgcggcttcactcctgaagtcaagtgagaccacgaacccaccggaaggaagaaactccagacacatctgaacatctgaaggaaaaaactctggacaaaccatctttaagaactgtaacactcactgcgaaggtctgaggcttcactcctgaagtcagcaagaccacgaacccaccaggagcaacaaatgactctggacgcaccaccttttaagagctgtaacactcactgccaaggtccctggcttcattcttgaagtcagtgagaccaagaacccactggaaggaactaattctagacatgctagttcccagatcctgtttctctggagaggcctaactaatacatagacaaagccaaatgactttttcccctctctgaactttgatattctttaaacatttccagctagttcttttaatatttcttgaggatttcctgggattttttttttggtaaatactgtatttcaccagctactccttcaagaacatagtcgtcatatgctttattatccatgaagattattagtgaacccacagttcgtttgtcaaaatgactctaaattcgtgatattcagatgatcacactccataatactgccaccagagccaagttattggagttactactttttatgatcagcacaattatttttctatgaaagaattgttggtattaaaagggccacagtagactatttgctattgaatgattgttggttagtacttaattaaaacaaaaatgttttttatagctacttaactccaagttccatcttttccatctctagaagtacataagccttttcgttgaaataacacatttttctgaagtagaacatgattattgttaagaaatataaaaatggcctttaatctcaccatttaagatagaaagcttttcat

SEQ ID NO: 263469 - DNA, 485 bp, Homo sapiens
gcagcccccagaacaaggaccccagagacagagtgagagagggcaagagaaggcaagatgcaagtcacactctttttgtaacctaatcccatcacatttcctgaattctgctcattagaaagaagtcactagattcagcccacattcaagatgagaaataccagaaggcagagaacactgaggctgttttagaggctgtcaaccccagggagacagacagcaaataagtaagcaaataaataaaaatggaaggtgataataagtgcaatgaaaagaaatgaagcagagtaaagaatcaagagtagcagttgaggggatgcttggatgttttcacaccactctgacacatggatggaaggttagaagacaacaaaggaatgggctgggaaggactccaaaagcagaatcagagattatatcattccttggaaatggagaaaaggatcaaaaaagctgaataaaaggtagtcccagcaacaatgtct

SEQ ID NO: 263470 - DNA, 813 bp, Homo sapiens
gcagcccccagaacaaggaccccagagacagagtgagagagggcaagagaaggcaagatgcaagtcacactctttttgtaacctaatcccatcacatttcctgaattctgctcattagaaagaagtcactagattcagcccacattcaagatgagaaataccagaaggcagagaacactgaggctgttttagaggctgtcaaccccagggagacagacagcaaataagtaagcaaataaataaaaatggaaggtgataataagtgcaatgaaaagaaatgaagcagagtaaagaatcaagagtagcagttgaggggatgcttggatgttttcacaccactctgacacatggatggaaggttagaagacaacaaaggaatgggctgggaaggactccaaaagcagaatcagagattatatcattccttggaaatggagaaaaggatcaaaaaagctgaataaaaggcaaacatggaggaacagagtttggagcaataccctgacttacattcagtactgttaatggctccagcatcttgaaacaaaccaattttggattttcagccgctgtccaagatgacgtgaactccaggctattgactttcctctaccttcaatggaaattgtcatggagaattaagtttttgacaaatctacagcctatgtgcagggcttcttcctgggtgtaacaataaggaatttggaaactgtctctagttttggcctggagtcacactgcagcttgagaccctgtcatttccatcaagcttgaaaatatacatcttaataaactgcaatacttcttaaaccttga

SEQ ID NO: 263471 - DNA, 575 bp, Homo sapiens
acctcatttaaacttattataaacacacatacacacaccccacaggtcccaactgcagaactattaaatcaacttgaagtaatgacaggtggataggcagatggaacaaagtacttcccataaacatagagtcggatttgaacccctatcgcacagccaggcaggggctactcacaaagttaactctcattcctctttgccctcattactccccataacttgctcatctttctgttgtagaattggtcactccggattgtacttatttgtttaacttcctttctatcaccacactgagcatcttaagggccacatcaaagctttttctatcagtacacccagagctcagcacagcattggcacactgtatgtgctcaataaatgcttatgaatgaaagaatatatgaattagtggggtagactctcacttgtttttgaaagtgtggtgaaaactcactctatttctatgtacaacactgcaaaattcaggtaattgttcatttattttagaattccttaagaaaattcaataagtaagccataatgaaataatttggggaatttaagagatcagt

SEQ ID NO: 263472 - DNA, 300 bp, Homo sapiens
aaatgagggcagagagcagggccctgtaggacaatgatatcatcacacagaggccagaaggccagttccccacatggtggtcacctctccactacagagcagggccttccagtaaactctagagcagtttagggatgaagtctgggccctgaaacaacatgtttcgaaacaacatgtttctgaggtttcatctgagcccactgccctcaacttactcgcctggagttttaggggttactgcttagtgcagtaattccccttctgagattaagataaaattgcccaaaataacaaaaaaaa

SEQ ID NO: 263473 - DNA, 535 bp, Homo sapiens
cagtggtgtgaagttaaaaccaggtactatgagtctcacctgatttttggttcttatgaaggtattttttttctgtgtagatagttgttaacttgtgtttggggatgattggtggaggcttctattctgctattttgctctgcctccctaattcaaatatgtggttaacttttatgggggttccgtgaacatttgaaaagaatgtgtactgtttatagcaggagtccccacccccaggccatggaccagtacaggttcatggcccattaggatccaggccgcaaagcaggaggtgaacggcaggctagcaagtgaagcttcatctgtgtttacagccactctccatcactgacattactgcctgagctccacctcctttcagatcagtggcagcgttagcttctcattggagagtgaacctattgtgaactgcacatgcgagttctaggtcacgtgcttcttatgagaatctaatgcctgatgatctgtcactgtctcccaccatcctaagatggaactctctagatgcaggaaa

SEQ ID NO: 263474 - DNA, 804 bp, Homo sapiens
aaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaa

SEQ ID NO: 263475 - DNA, 439 bp, Homo sapiens
aagagtggagctgatcaggcctatattgcagtgagagctccagccgtgaggactacatcaggcagttccttaatgctggcaagcacgtgacttttttgtttgttttttgagatggagtcttgctctgtcaccaggctggagtgcagtggtgagatctcagctcactgcaacctctgcctcctgggttgaagcgattctcctgcctcagcctcccaagtagctaggatcacaggtgcctgccaccgtgcctggataatttttgtattttttagtagagttggggataagccatcttgcccgcctcggtctctcaaagtggtagaattacaggcatgagcaagcatgcccagtgaactgtgaccattttgaaagccatgatttatgggaatagcagttatttctctttgtgtaaataaacagaggccaccaaaataagaac

SEQ ID NO: 263476 - DNA, 446 bp, Homo sapiens
aagtttaattaaagaccaaagatacagcgtgctcacgtagccctggcgcaccagagactttaggccaaagaaggagtacgtttcggtgaaaagcacacaacattactgcctgttcttgaaaacttgatctgtggtccctagttcccaaggatgggaaagtggccaaagcccactcaatgctgggagccgtcctcctagagccagagggatcctgcctgttccaatgtctccgtgggttttacgggcatatttttcacaccctgttttgctattaaaaataaaatgaggcacacatcacatgtctttcccagactgcaagacccatttccttctaataagcctcggtttgcctgggctttccttaccctagaaacattaactctcccgaggtgcctattatggatttctagttttgtattttttttcctgtttctgctattttgaaa

SEQ ID NO: 263477 - DNA, 728 bp, Homo sapiens
tactttatctaactcaataagggatagtttcccatattgagttagataaagtatgaagtattttatctaactcaatatgggaaactatcccttaatggatggctctaagtcatctgcatttttcctctctgctgtgaagctattctctgctccagtttctctcttggtaaaaaactactcctaccaactttcctttctatttttttaaagcttcccatttctattcattgaaatcttgttgatatggcttttcccaaagaagaattccgaagctgaaactccaatatggtcccaaggttcttaaagtatggaagatggaatgtttgttaacaatgcagactcttggaatccatctgagttagagtaggaatcagtctccatggaagggcccagaaatctggatgtttaacgtgtgccttgttggttcttatgcataataaactttaacaacaactattctagaacgctagttctgatttggagagaacattcaaaatgtagtcgtagactttcagttgctagcttcatggatatatatgttatttaatccctctgagtcccaatttctttatttttaacattagcataataatttttaggatataatgttaatgaaaagattgcctggggccacagatgttttgtttctgtttgctttttacaaagcatatatacctagataaacaaccagagtaagaaaaacaaaacccacaagaatacagtagcag

SEQ ID NO: 263478 - DNA, 371 bp, Homo sapiens
ttttatttagtgatatatttaatagtcacacacgcagatttattctatcattctttcatatcccttgaagacatgaccaccacgcttcactccctgcctgtgacacagaggaagctctgagatgaagagtcctctccgccaccagaagcagcagcgaaaacccatccaaagggttcaagaaaaactttcattctgagaagaggaaccgggtcggggaggcacgccggactccacatcatttcttccttcaattttgaaggagagtcgagggctggaccatcaaggctttagtctgaattcaggcctaatgtgagaattaaagaacagaaaccgccaaaaaaagagcacataatgcgatcattggcctcata

SEQ ID NO: 263479 - DNA, 363 bp, Homo sapiens
gcatagattaaataatttgcccaatgtcacacagtaagtggcagagttcatatcccttgaagacatgaccaccacgcttcactccctgcctgtgacacagaggaagctctgagatgaagagtcctctccgccaccagaagcagcagcgaaaacccatccaaagggttcaagaaaaactttcattctgagaagaggaaccgggtcggggaggcacgccggactccacatcatttcttccttcaattttgaaggagagtcgagggctggaccatcaaggctttagtctgaattcaggcctaatgtgagaattaaagaacagaaaccgccaaaaaaagagcacataatgcgatcattggcctcata

SEQ ID NO: 263480 - DNA, 781 bp, Homo sapiens
gtccactcagctagtaagtggcattttggctccagagttcatgatcttaagcatattctctgttgctttattggaagactaaaccttttaagatagatattctataattcagtgggcttcctaaatacaaatggagaaaacagatgtggattcacctttcctaaacgctttgcctctctttaaattcttcaactgagtgatcctctctgggatcactcatatttgcagtaagccaagactgtgctgctgcactcctgcctgggcaacagagcaagactccatctcaaaaaaaaaaaaaaaaatcagttgtatttgttccaaaacttgtttttgcaagttgtacttaataacgatgtaatttaattcaatattaccaaaatcaaacaattatgagtgtgaagagagtaatctctatgaaaaaaagttgaaaacttgggaaagacctgataaaagacgtgttattaaagaaaaaaatgctgtggaattaggtgtgggtaaagcaaccgtgaatgtttgggagggagagaaaagtgtcaaaatataggactttgccttcattttgtttcacaagtgtcttgagtcctcattctactaaagctgaaattgataatgcttcttgctgtgctaatcaatgtcctctgtgcagcctgcatcagcaggcccacacgcaaagaaaaggtcttatcctgacatcaaaggagtgatgggtagataaacctgtttatattttaaattaaaaataaaattttgaagatatatataataattttatgaagcccca

SEQ ID NO: 263481 - DNA, 541 bp, Homo sapiens
acaggatctcgctgtgttgcccaggctggtctcaaactcctgactcaaaatttaatttttaattgtgaatagaaaaaaatatatttgtttttgcaagttgtacttaataacgatgtaatttaattcaatattaccaaaatcaaacaattatgagtgtgaagagagtaatctctatgaaaaaaagttgaaaacttgggaaagacctgataaaagacgtgttattaaagaaaaaaatgctgtggaattaggtgtgggtaaagcaaccgtgaatgtttgggagggagagaaaagtgtcaaaatataggactttgccttcattttgtttcacaagtgtcttgagtcctcattctactaaagctgaaattgataatgcttcttgctgtgctaatcaatgtcctctgtgcagcctgcatcagcaggcccacacgcaaagaaaaggtcttatcctgacatcaaaggagtgatgggtagataaacctgtttatattttaaattaaaaataaaattttgaagatatatataataattttatgaagcccca

SEQ ID NO: 263482 - DNA, 517 bp, Homo sapiens
ggaggctgaggtgggcagatcacttgaggacagtccaagaccagcctgccaacatgatgaaaccccatctccactaaaaatacaaaagttagctgggcatggtagtgggcccctgtaatcccagctactcaggaggctgaggcaggagaattgtttgagcctaggaggcgggggctgcagtaagccaagactgtgctgctgcactcctgcctgggcaacagagcaagactccatctcaaaaaaaaaaaaaaaaatcagttgtatttgttccaaaacttgtttttgcaagttgtacttaataacgatgtaatttaattcaatattaccaaaatcaaacaattatgagtgtgaagagagtaatctctatgaaaaaaagttgaaaacttgggaaagacctgataaaagacgtgttattaaagaaaaaaatgctgtggaattaggtgtgggtaaagcaaccgtgaatgtttgggagggagagaaaagtgtcaaaatataggactttgccttcattttgttt

SEQ ID NO: 263483 - DNA, 412 bp, Homo sapiens
caggagttctttatcacattgaacagagctccactgggatgtggcctccaacattctagttctcaacaatggagcccaacataacaagtctgcaccctcttttcaagtatagcccttcagacctgcaaaggcagttctagagtgccctgtcaaggtctttttttctccagatgattagatctcttaatatttccccttatagtacatagtcataattataagtcctccctatgctgacatattaatacaagtttgcttaataaaaatgaaataccaagtaataaccaattttactatttcccttctctgttccaggcagtgttccccacactagagatacagagttgaaaaagacacacaggatccctacttcatgaagcttactttattgtagagtaagaaaaaaaaaaaa

SEQ ID NO: 263484 - DNA, 531 bp, Homo sapiens
tgggtgatggctactttggtgtccattgtactattgattgtataagtttgacattctccataaaaaggataagcaagaatacattctcagaagaaaaagacaagtgaaaaatcaccaaaggtcctgggcaggtgttttgaagtgtcaacgaacagagtagattgcaggatagggaggtggggaactgagtgggaaaacctaacttgaggccagactacatttaaagcaatttgaggacttccgagtgggaaagtccaagtagggaaatggcgatatgaagatggagcttgggagagacgtttgtagctctgcacttaggataatgaaagccacaaacataaagaagcgttcagggggcagagataccgttgcaccacagggaatgaaccaactaggaaaggaaaaaaaagaaagcctgttgagctcataaaggagataattagcccaagctcctacctacattttacttttgttttagaaaaccaataaacacctctcagaaatggagctccatttcactcttgccaccta

SEQ ID NO: 263485 - DNA, 241 bp, Homo sapiens
ttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatg

SEQ ID NO: 263486 - DNA, 399 bp, Homo sapiens
ctctgtgaaaagaagtgaggatgcaaacaaacaaacaaaaacacatacaccttctgtagcccttaggctagtgatcattgtttgatacagatgagttaagaattccaaaaattatcttgtagttttacactcctgatacaaaaaccacttgagggttggatatataatcaaatattaagtataaaattagtaagtcactaaaataaaatgtaggaatgtatttatataatacattggaggaaaaaaaatatgttcaccaaaatcttttggaagacagtattatgtttgtttggaagacatatttaataagctgcttgggtttcagaccaagaccttcaaggaatgcttgcacatcaaaaagcagttcattaattgctctgcgcaattaaaaaaacaaac

SEQ ID NO: 263487 - DNA, 583 bp, Homo sapiens
attgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaa

SEQ ID NO: 263488 - DNA, 497 bp, Homo sapiens
catacttacctggcaggagagataccctggtcacgaaggtggtttttccagagcgagtcttatccattgcactccggatctgctgacccctgcagtttccccaaatgtgggaaacttgactgtataatttgtggcagtggtagactgcattcgcgctttcccctgtatttttgtcgttttaaaaataggttttgtttgctgcagaaacgcatactgggcgtcagcgtaagctgagaatcaggtctttgttcccatctgtaacttcactgaaactaaaaatttgggacatcgtggttctcacgtttgtaatcccagcaatctatgaggtacgtcgataggttatgtttatgttaatatcgctcgacctcaggcgtgtgtgggcaaatatagtgaacccgtctctactaatctcttatctttttttgttgttgttctatagaaataaaactaagcttttcttttccctatgggattaacagcaaacagtccgctggagt

SEQ ID NO: 263489 - DNA, 522 bp, Homo sapiens
  misc_feature (519)..(520): n is a, c, g, or t
  misc_feature (522)..(522): n is a, c, g, or t
caaatccatagggagctctgccttaccattgggttcctaattaactgagtgagtgggtgtgttctgcatggtgagaggcattggaatgatgcatcagaaaacatgtcataatgtcatcactgtaatatgacaagaattgcagctgtggctggaacctttataaagtgaccaagcacaccttttcatccagtctcagcgtggggtgaagcctagcagctatgaggatccattatcttctgtttgctttgctcttcctgtttttggtgcctgttccaggtcatggaggaatcataaacacattacagaaatattattgcagagtcagaggcggccggtgtgctgtgctcagctgccttccaaaggaggaacagatcggcaagtgctcgacgcgtggccgaaaatgctgccgaagaaagaaataaaaaccctgaaacatgacgagagtgttgtaaagtgtggaaatgccttcttaaagtttataaaagtaaaatcaaattacatttttttttcaaaaaaaannan

SEQ ID NO: 263490 - DNA, 284 bp, Homo sapiens
ttaccaagaggcaattgttacaacttgataggagaaataagttctggtgttctgtgcattgcagggcgaatagggttaactataatttattgtgtattttttaaaagctagaagagaggatttttatgttcacagcacaaagaaatgataaatgtttgtggggatagtatactaattaccctgatttgataattatacattgtatacgtataccaaatatcactctgtatctcataaatatgtacaattattacatgtcaactaaaaataaaaggagaaaaaaa

SEQ ID NO: 263491 - DNA, 592 bp, Homo sapiens
ggctcctatcttgaagctgttgggcacctacgcaagtggcacagggaggggcagggtgttggctccgagtgagagatttgcttaagccagatggtggccgatgaaggaggcccaggcaaccccttctggtcttccagacagcaccacaggtttgtgtgggttggaggggtgctatctgtctgtccatccacaagcacatgccagaaagaagaggatggaggaggtgaagattttggggggttctcatcattttccctttccaagtttcatccttatccatgcttctaatcacatggagaccattaccactgggggagtcatttccatttttctttagattccattctaaaatcccctaaagacctaaagtaaagaacgtcagcagtggcatttctattcctctaaagggtattttagacaataattttggatagccccacactgcatgaagcagggaactgcatgcccttcctgctcgggagcccagccctgcctccagcagctccagcttcctttcctctctgtcatggtgctgccttctgatgagcaagaagttagtcccgactggccctcggcaagctggggcttctaa

SEQ ID NO: 263492 - DNA, 336 bp, Homo sapiens
gagatggagtaaatcaaaacaggaaatgggacctggctacattaaaagagaaagcagaggccgggcatggtggctcacgcctgtaatcccagcactttgggaggctaaagtggatcacctgaggttaggagttctgaggccagcctggccaacatggtgaaacctcgtatctactaaaaatacaaaaattagccaggcgcggtggcgggcgcctgtaatcccagctacttgggaggctgaggcaggagaatagcttgaacccgggaggcagaggttgcagtgagcctagatcgcgccactgcactccagcctgggtgacagagcgagactcttcct

SEQ ID NO: 263493 - DNA, 451 bp, Homo sapiens
ccagatactctactgactgctatatatagacattatgaatgcttttcagtgctagatctgaaagatgttttcttctgcattccaattgaagaaaagacccaacaattatcattattatttttaatgacaggaccgagagactaaaacaacctttcaatactgttagacagtggggtctcaatgtgttaaaaaatgcaccaacaatttttggggaaatactggcaaaagacttaggagacctacaacaagattaagaagcctggctacaacacatagataattaatagccagccacaactataggaaatgcttagctgatgtcattttagttctaaatcacctggtacaatatggatacaaagtattcccaagaagccccaaatatgtaagtagaaagtaacctgtcttggctttaggttaaagcaaggccaaaggagcctggtctggtaaa

SEQ ID NO: 263494 - DNA, 441 bp, Homo sapiens
gtggggagatgaatgaagagttaagcctgactcccagacttctggcttcaatgctaacagattagtggtaccatctattgagattaaaatttaccaagatggcaaaggaagtctgtttctggatatattaaatttggggcagctaccaaattttcgagaaagagccagtggttagttaaataaagatctgtatcttagggaagagatgtaagctggagaaaaagatgccacacaggtgaccatcaaagtcaaagatgctgatgagattacataaggaaaagcacatgaaattggagattagaagaatgagagcaacaaccttgaagaacaccaacatttagaagcatttaaaaagacagagcaagaagaaatgtaggatgtggtatcagagaagccaaggaagaaataatttcaaaaagtgaagtgttaagttttaactgc

SEQ ID NO: 263495 - DNA, 755 bp, Homo sapiens
tgcccagcctgctctggaactcctagcttcaattgaccctctgcctcagcctcccaaagtgttgggattgcagatgtgagccactgtgcccaacctgtttttcttggtgttttatataaatggaattgtatcgcacgtaatctttagggaagtgggggctgttcattgagcataattatgttggaattcatctatatattgataaatattttaagtgctttttattgctgagcggtgtctaggagtcattcttgcttaccctttcccactgcagccttcactcaatctcatcaaagatctagctccaatatataaaccaaatccaagccattcccacgtatattacccctgagccatgctctctcacctagattacagatacagcctagtacctggtcatcctccaatcagttttgtctacagccatgcgagtcttctctctatgccttaaataagacaaatgtattccagctcttttgaatatttccaattgtgaaatgttcctctttatttctaataatgcttgctattgtcaactttgcctcatatgtaaataacaccaccagctttctttcctgtgtgtacctttagagttaagtgagtttaagaagtgtgtgtgtggccgggcgcggtggctcacgcctgtaatgccagcactttgagaggccgaggcgggcggattacgaggtcaggagattgagaccatcctggctaacacggtgaaaccccatccctactaaaaatacaaaaaaaaa

SEQ ID NO: 263496 - DNA, 312 bp, Homo sapiens
ggcgtgggcctgtaatcctagctactccgaaggctgaggcaggagaattgcttgaatccaggaggcggagttgcggtgagccaagatcacgccactgcactccagcctgggcgacaaagcaagacttcttctcaaacaaaacaaaaaacaaaacaaacaaacaaacaaaaaatgactgtgttaacgactggcttgcaaaatttctgaaaattcacaattggctccggaggatggggttgatccaactccaggctgacactgcccctggggtgagggcccccaggaattggagggcgggggctgaggggacgg

SEQ ID NO: 263497 - DNA, 3052 bp, Homo sapiens
gcagtgttttcttcttggggtcggaataaaagggctggaataaaagagggcaggaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggta

SEQ ID NO: 263498 - DNA, 3833 bp, Homo sapiens
gtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263499 - DNA, 3868 bp, Homo sapiens
  misc_feature (261)..(261): n is a, c, g, or t
  misc_feature (282)..(282): n is a, c, g, or t
gtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgnagccggccgcgggctcggggntgtcccaggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263500 - DNA, 2108 bp, Homo sapiens
gcagtgttttcttcttggggtcggaataaaagggctggaataaaagagggcaggaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgcccaggcttcagtgcctgaccaggcttcagtgcctgaccaggcttcattgcctgaccaggcttcagtgcctgaccaggcttcagtgcctgaccaggcttcagtgcctgaccaggcttcagtgcctgaccaggcttcaggtgcctgaccaggcttcagttgcctgacacaggcttcagtgcctgaccaggcttcagtgcctgaccaggcttcaggtgcctgacc

SEQ ID NO: 263501 - DNA, 1669 bp, Homo sapiens
gcagtgttttcttcttggggtcggaataaaagggctggaataaaagagggcaggaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggccagggcggtgccccggctcccagcccgcagcccctgcagaaagaccccagagctgcatgtcaggcacagggtgggtgggacagagggagagagcaatgcactccagctcctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagacc

SEQ ID NO: 263502 - DNA, 724 bp, Homo sapiens
  misc_feature (261)..(261): n is a, c, g, or t
  misc_feature (282)..(282): n is a, c, g, or t
gtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgnagccggccgcgggctcggggntgtcccaggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgctgggctcatacattgagctgcccagcatacactcaagttgcctcccggagccgtgctagctcctcgctgatctta

SEQ ID NO: 263503 - DNA, 410 bp, Homo sapiens
ttgcttgaatccaggaggcggagttgcggtgagccaagatcacgccactgcactccagcctgggcgacaaagcaagacttcttctcaaacaaaacaaaaaacaaaacaaacaaacaaacaaaaaatgactgtgttaacgactggcttgcaaaatttctgaaaattcacaattggctccggaggatggggttgatccaactccaggctgacactgcccctggggtgagggcccccaggaattggagggcgggggctgaggggacggtcccttaaggccttatgcccacagtcgccttttcctcccccagatcctctccttcatcctgcacacaatcgtgcgaggattcatccactccgctgtcgggggcctgtacgctgccgtgtaagtcctggaagccgcaggtggcctg

SEQ ID NO: 263504 - DNA, 208 bp, Homo sapiens
gggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggta

SEQ ID NO: 263505 - DNA, 3673 bp, Homo sapiens
gcagtgttttcttcttggggtcggaataaaagggctggaataaaagagggcaggaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263506 - DNA, 3533 bp, Homo sapiens
gcagtgttttcttcttggggtcggaataaaagggctggaataaaagagggcaggaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgcctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263507 - DNA, 2357 bp, Homo sapiens
gatccctcggcaggtgtctgcccgaggagaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263508 - DNA, 2034 bp, Homo sapiens
tgccgctccagctggcgccggtagcagatcaggtagagcgggaggcagaagcccagcaggctgagaaggagcagccccacgttcacccacagagggtctccctggagaggacccatcatggccagaaacagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgagttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagactctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcagtctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggggcacgcctataatcccagcactttgggaggccaaggcaggaggctcacctgaggtcaggagttcgagaccatcctgaccaacatggagaaaccccgtctgtactaaaaataaacattaatcgg

SEQ ID NO: 263509 - DNA, 1140 bp, Homo sapiens
gtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcaggtcagtgtgggtcccttagggggcagggagtgggcaggtggaccccctgggctgagttccccacagaagggtatcctggtcgtacctgatatcaggtgtactgtggagctccctgaaggccctccagaatggagttcctaccccgtccgccaccgaatcagcaggtactgtggtcctcgccgtgctccagtactgaataagaaaagctccaggctccaggccgcccagggaccggagctgcttgtcactaagaacatgtgtttcccatccctttgtagttcataagcatgataattggggtttccctcgcatgtgtgagacatgcttccctcaaaccttgttacgaagctggcacagtatccatctgatgagaaaaaaaaccaacaacactggtttccacagcccgtttgaccttataactccagcccgggtgacagagcaaggctctgtctcaagaaaaaccaaaaacca

SEQ ID NO: 263510 - DNA, 291 bp, Homo sapiens
accttggagctattcacagttccactctccacagatgcagccctgacactatgccacctgctgagctcctgggtgtcactggagagcctcacactctcctacaatggcctgggctctaacatcttccgcctgctagacagcctgcgtgccctgtcaggccaggctggatgtcgcctccgtgccctgcatctcagtatcctgggaaccctgggccaggaggttacagtggtcatcataattgctgaagagatcccctcccctgcccctgggttcctgccttccctcctcaag

SEQ ID NO: 263511 - DNA, 798 bp, Homo sapiens
ttattttcccccttgaaaccaaagagatgtggaacaaatgccttttctgtaactgagtttttgtctcatttgaagttagggtgcttagaagcccgtgagctaatgatgctaatttccccatcagaacaagtgaagagccggagttctcccagctgagggcactggatgggtgaacacgtcttgtggatggactctatccgtgtcatttcgccaacgataaaaataactctagagaagggaattttgttttacactgaagggaaaccagagttccagattgctaattttttttaagttctcattaacatttgttctttaagcccatgcgtatacttcttcccattgggataacaaagggtatggttctaattagttattggctggcatttctctaaagaaaattgaaaaattatggtggggaaagaaaatgctgtgtggtatttctttttttcttttattaatttctcctttatatagttaaaaaaaacctggggatgaccgtatatgttaagcctgcattttgcctggttcctctcaccttgacaggaactgtgagaaaacaccaaaaaaaaaaggacaaaaatgtaaaaaaacattctttatacaaaattgtcctgtttctgcctgttgtcatggtaggtacaaaagtaattgaagcttaatttttttggcttccaaaacacatattatttcagcttccaaaacacacattattatatagctgtgcataaattgtaattagatggtaatagaactttgagagcatttataacaatttcatcagcaaatctataatcc

SEQ ID NO: 263512 - DNA, 258 bp, Homo sapiens
ctttctcttccctttccaacaaagatctagattccaagtagtgatctttttgatgagtcctctatcaaactatgacacatgtgaagaacatacctgaacaaccctcagggataatgcaggattttttgagaaagttccagggtatctcctgatgtcagtgtactttcagtcctacacctcagcctcccgaaatatgtggattacttgtgtaagccactgtgcccagccttacctgctttaaaaacaaacaaacgagca

SEQ ID NO: 263513 - DNA, 463 bp, Homo sapiens
gggcagtagtagttctctacttaattcaggtctcatgattttcaaattgtaattaataaatcctacatgaatagccccataattgcaactgtttagagtattagcaaagaagactagagaattgaatactttcttaaattttatttcttgtaaataatatactaaatgagtaaacagttattttaattttgatatattacctctaactataattgactgaataggcaagttgttaataaaatactatttaaggaggctgaataatgttaatgaatctattgatatactttaatgataaagtagatagtatttcagtgaatataaatataattgttttatttatttgtttatttatactacttccagagaggacttacacatcttccagtaaaaatacagtattattctggtcattaacatttattaatacatccatcaagtaataaagggagataaaaaaaaa

SEQ ID NO: 263514 - DNA, 203 bp, Homo sapiens
ggaaattaaaaaattccttgatctgaatgacaataatgacaaaacctatcaaaacctctgggatacagctaaggcggtgttaagaggaatgttcatagccataaacacctacatcaaagagtctgaaagagcacaaacagacaacctaagatcacacctcaaggaactacagaaacaagaacaaaccacatccaaacccagta

SEQ ID NO: 263515 - DNA, 1628 bp, Homo sapiens
aggagcaggggagacctatcagtagggtgaccacgtgtcctttgcctgggcagtccaggtttatgcttgttttccagtgaattagacccccttccacttttcaaaaaagtcctggtttagatgctgtgatcaccaaacatatcaggaaacaatattccttggtcttgcttccctatcttcaggtactggtgggccaaattcctgggaccaggtcaaggtgggctgcctcagtaagaaggaaggactggagagtgcccatttcagaggagcaggctggtgggggccagccagaaagtagttccctttggggggaagatgttggacctttattatttgtggtaaccagccgaggctggttgtcaggacagcaggtgagccactttagggaagaaagtgcaggggtgggtggatgcccagattaccaaggccagccaccctgatggggtagggtctggttatctgtgttcaagaagcaaatcccaccccagccccagcactagctctctatgtatgtattttccctgtacaatgttttataaaagagatcattaatttatctgctatgttaaggctcgaggggtggggcgtagactctcagctgtatattgctctggggtgggcagggaaggctgagtctcacttgacttggaagataaacaggccagtttggactggcctccagctccgtggctgtgtttgtctaacaaggatttgggtaactactggatacaagccactgtgcttagtatggatagactgccatcagctcacccacatgactcctgttcatggcaagctaatagtctgtctggtggaagaggattgaaaaagcacacaaaaacatcataaattacaaggagtagtaagaaggaaaaaacagggaacgtgagagaataactagcgagtggggagaggagtggatttactttaacagggtagtcagggaaggcctcttgtggtggtgacatactgatttaggcaaagcatccagcacgtgcctagcgcttagtagttgctcagcaaatggcatctttgggtgatgaatacctcacatttgtatatggcctgtcacagttttccataaagcttttttttttaaggccatcttgacgtcatacttttagaatattttattttattattattattattttggacggaaccttgctctttcaccaggctggagtggaggttgcagtgagccgagattgcacaattgcactccagcctggcgacagagcgagactcgtctcaaaaaaaaaaacacaaagaggggggcacactccgcgataagaggaggaaccgtgatctcttatacagaagatctctctccattttaatgtgccacaaataaccgcctcgacctcctggctataattgaagcacaccccaatatttgattaaacaaagccatgggcaatcccatatgaagggggcagggtataggtcgggcaaaataaaatgcgtagccctttttcacaaggaacctcaccctatccccatagtttttagaccccccattatttaaagcgcgcggcgaccgaaatatggcgcacatcccatggagcgcacataaagacctctattacaatagacaagcgacccgctacctccaaaaagaagggttg

SEQ ID NO: 263516 - DNA, 1104 bp, Homo sapiens
aggagcaggggagacctatcagtagggtgaccacgtgtcctttgcctgggcagtccaggtttatgcttgttttccagtgaattagacccccttccacttttcaaaaaagtcctggtttagatgctgtgatcaccaaacatatcaggaaacaatattccttggtcttgcttccctatcttcaggtactggtgggccaaattcctgggaccaggtcaaggtgggctgcctcagtaagaaggaaggactggagagtgcccatttcagaggagcaggctggtgggggccagccagaaagtagttccctttggggggaagatgttggacctttattatttgtggtaaccagccgaggctggttgtcaggacagcaggtgagccactttagggaagaaagtgcaggggtgggtggatgcccagattaccaaggccagccaccctgatggggtagggtctggttatctgtgttcaagaagcaaatcccaccccagccccagcactagctctctatgtatgtattttccctgtacaatgttttataaaagagatcattaatttatctgctatgttaaggctcgaggggtggggcgtagactctcagctgtatattgctctggggtgggcagggaaggctgagtctcacttgacttggaagataaacaggccagtttggactggcctccagctccgtggctgtgtttgtctaacaaggatttgggtaactactggatacaagccactgtgcttagtatggatagactgccatcagctcacccacatgactcctgttcatggcaagctaatagtctgtctggtggaagaggattgaaaaagcacacaaaaacatcataaattacaaggagtagtaagaaggaaaaaacagggaacgtgagagaataactagcgagtggggagaggagtggatttactttaacagggtagtcagggaaggcctcttgtggtggtgacatactgatttaggcaaagcatccagcacgtgcctagcgcttagtagttgctcagcaaatggcatctttgggtgatgaatacctcacatttgtatatggcctgtcacagttttccataaagcttttttttttaaggcca

SEQ ID NO: 263517 - DNA, 465 bp, Homo sapiens
ctgagatttgggagagaccaggggcagaatgatatggttaggctttgtgttcccacccaaatctcatcttgaattataatccccataatcccctcgtgtaagagagagaccaggtggaggtaactggatgatgggggtcgtttcccccatggtgttctttcgatagtgagtgagttctcacgagatctgatggttttataagtgtctggtcattcctctggcattgtccttcctgccgccttatgaagaaggtgccttgcttccccttcaccttccaccatgattataagtttcctgaggcctccccagccttgctgaactgtgagttgattaaacctctttccattataaattacccagtcttagtaattatagcagtgtgaaaacatactaatatggggaggatagcttgagcccaggagtttgagaccagcctgggcaacacagcaagaccctcatctcttc

SEQ ID NO: 263518 - DNA, 297 bp, Homo sapiens
gaaggtgaccttgagtcctcagctgttgctattgttatcctctccggtgcattctaaagttccctcactcttccaagaacccttgactatgcttgtcttgatcgcttatctaattgtgacccagaatgtcatccctgagaggtctgacttcctgatcaccatgtccttcttagtccatgaccactgtacttgtcaattttctgtcaagatatggcaaggaggtaccaaaagacaccccagtgattatactcttccctgtcatggtaaaaactgtgtatctgcagccccactgctcta

SEQ ID NO: 263519 - DNA, 194 bp, Homo sapiens
acttaattcatcaacactgacatagattgcattaaaaacctttccatggatctactcttcctatgtaaaactcagagacatgccttttccatgctcctaaaacagtagccatgagaaagtagcttaagcccaggaggcagaggtacagtgagccaagatcgtgccactgcaccccagcctggataacacttctc

SEQ ID NO: 263520 - DNA, 445 bp, Homo sapiens
gtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattgattgagttcgggtggtcaaggccacaaaaagccgcgattgcaccactgtacttcagcctgggcaacagaacaagacac

SEQ ID NO: 263521 - DNA, 471 bp, Homo sapiens
acatcagctcctctccagtggcaggacactaatactagaaaaacgccagctcctcccgggttctacagctgtgcgaccctcaaacaaaagaaacaccagctcctctctgggtctgcagctgcaggaacctcaaactaggacacctctccccctggatctccagctccacgaccctcacagaggaacagccacatcagctccttcattgccttcagctccacaatctaagacatcagtggcagcaccagctcctccgtggacgtccagctcaacgactctcagacttaaaaggcagcatcggcccctccccaaggctccagctccaccaccctcaggtttgaacagcggaatcactagctgccgtccaagtcttccgccccacaaccctccctgaacaatcccttctcatgaaattcagcagtcaagaaaactgcagcagaagtaaatgaataaatgttttgttttcaaatc

SEQ ID NO: 263522 - DNA, 1142 bp, Homo sapiens
gggctgtagcaggagacctgcggctgcatctcccaggccttccggcggggccgaggcacacaatactgagaccagaataaagcagtgcatttactaccttgtgaagaatgttcaggtgttcagtgggcttgatccagtcaggtgaaggtctgaagagaaaaaaagaccgtcctcttcccagaacaagagaatcctccaacagatacctttggactggaccttgcaccatcagctttcctgagtttccagcctcctgcctcacactccagcttttggacttgttagacttaataataacaacacaagccaatccttttaaggaagtttgtctggagaatcttgacaaacacaaacatctactgagagttcctgtccaagttttgctcacaccctagcaagaggcttctggcttaccagttgagagtgtgaggttctttgcttgtaagacctgatccaccagcggtacaccagctctggcccagggcaagacagggaatttcccaatcactgagtaggctgtagccactctctccattaggcctgacttcaccatggggaaggggagaccctttcaagggtattctttcctggggtactctcagtcctaggacatcatagctctctttcatccctcttaaaagttaataccattatcagttaacagttttttatattaaaattatccctgttcaagttaatggtatggtttctgtatcctgactggatattaggatacagtatttactgtcttatttctactactttatgtttaaagtttttcataatatttaaactgaagttttgatcattcattaaatatttacacagaacaggacaaaggatgattttcctttgtctagttattgtaaggtagcgtccaagatttaccaccacatcatgattacagatggtcaccaacttatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgacgggtttattgggaattaaccacaatgtaaa

SEQ ID NO: 263523 - DNA, 1796 bp, Homo sapiens
gggctgtagcaggagacctgcggctgcatctcccaggccttccggcggggccgaggcacacaatactgagaccagaataaagcagtgcatttactaccttgtgaagaatgttcaggtgttcaggtatggtatcttcattttgtgctgctataacagaatacaggagactgggtaatttgtaaggaacagaaatgtatttctcacagttctggaggatgggaagtctaagatcaaggagctggcacttgttgactagggctttcttgctgtgttctcacatacagaaggcaagctagcaggatgctccctgaaacctcttttattatgggccttcatcccagtcctaagagaatccctcatggcctagtgatctcttaaagaccccacctcttgatgctgtcacattggcaacacttgaatttgaggggacacatacaagccatagcaaactgaacatttctcccatgccagatagcaccatgttctttgtcagtaggtggtggtagaggggcactgcaggataaaggggcttctttcacttctaagatgatactgtgacagttaattttatgtgtcaacttggcggggccacaggtgcctagctactgggtcatactttttttttttttttttttagagatttaacttttgctctgattttccaattataaggtcaaacattattctaggtgtttctgtgagggtgttttatatgagattgacatttaaatcaatcagtgaactctgagtaatgcagactgtcctcctcgatgttagtgggcttgatccagtcaggtgaaggtctgaagagaaaaaaagaccgtcctcttcccagaacaagagaatcctccaacagatacctttggactggaccttgcaccatcagctttcctgagtttccagcctcctgcctcacactccagcttttggacttgttagacttaataataacaacacaagccaatccttttaaggaagtttgtctggagaatcttgacaaacacaaacatctactgagagttcctgtccaagttttgctcacaccctagcaagaggcttctggcttaccagttgagagtgtgaggttctttgcttgtaagacctgatccaccagcggtacaccagctctggcccagggcaagacagggaatttcccaatcactgagtaggctgtagccactctctccattaggcctgacttcaccatggggaaggggagaccctttcaagggtattctttcctggggtactctcagtcctaggacatcatagctctctttcatccctcttaaaagttaataccattatcagttaacagttttttatattaaaattatccctgttcaagttaatggtatggtttctgtatcctgactggatattaggatacagtatttactgtcttatttctactactttatgtttaaagtttttcataatatttaaactgaagttttgatcattcattaaatatttacacagaacaggacaaaggatgattttcctttgtctagttattgtaaggtagcgtccaagatttaccaccacatcatgattacagatggtcaccaacttatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgacgggtttattgggaattaaccacaatgtaaa

SEQ ID NO: 263524 - DNA, 1740 bp, Homo sapiens
gggctgtagcaggagacctgcggctgcatctcccaggccttccggcggggccgaggcacacaatactgagaccagaataaagcagtgcatttactaccttgtgaagaatgttcaggtgttcaggtatggtatcttcattttgtgctgctataacagaatacaggagactgggtaatttgtaaggaacagaaatgtatttctcacagttctggaggatgggaagtctaagatcaaggagctggcacttgttgactagggctttcttgctgtgttctcacatacagaaggcaagctagcaggatgctccctgaaacctcttttattatgggccttcatcccagtcctaagagaatccctcatggcctagtgatctcttaaagaccccacctcttgatgctgtcacattggcaacacttgaatttgaggggacacatacaagccatagcaaactgaacatttctcccatgccagatagcaccatgttctttgtcagtaggtggtggtagaggggcactgcaggataaaggggcttctttcacttctaagatgatactgtgacagttaattttatgtgtcaacttggcggggccacaggtgcctagctactgggtcatactttttttttttttttttttagagatttaacttttgctctgattttccaattataaggtcaaacattattctaggtgtttctgtgagggtgttttatatgagattgacatttaaatcaatcagtgaactctgagtaatgcagactgtcctcctcgatgttagtgggcttgatccagtcaggtgaaggtctgaagagaaaaaaagaccgtcctcttcccagaacaagagaatcctccaacagatacctttggactggaccttgcaccatcagctttcctgagtttccagcctcctgcctcacactccagcttttggacttgttagacttaataataacaacacaagccaatccttttaaggaagtttgtctggagaatcttgacaaacacaaacatctactgagagttcctgtccaagttttgttgtaagacctgatccaccagcggtacaccagctctggcccagggcaagacagggaatttcccaatcactgagtaggctgtagccactctctccattaggcctgacttcaccatggggaaggggagaccctttcaagggtattctttcctggggtactctcagtcctaggacatcatagctctctttcatccctcttaaaagttaataccattatcagttaacagttttttatattaaaattatccctgttcaagttaatggtatggtttctgtatcctgactggatattaggatacagtatttactgtcttatttctactactttatgtttaaagtttttcataatatttaaactgaagttttgatcattcattaaatatttacacagaacaggacaaaggatgattttcctttgtctagttattgtaaggtagcgtccaagatttaccaccacatcatgattacagatggtcaccaacttatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgacgggtttattgggaattaaccacaatgtaaa

SEQ ID NO: 263525 - DNA, 1308 bp, Homo sapiens
gtaccaatcacaagtcttgttattttgtttcattatgagaaagataatctactaaatattaaaatactggaaggagcaagatagctttgatccagggagaccttttccatttatgtgctttagtaatctgccgccaacaagctatcttctttatgttcttctacaactgatgttgtttgttttctcatgttgtctcttaatagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggttggaaatgagatcacatcggaattaggagagagtggagtgttcgggaatcattctcctctggaaagggtgtctggtgtggtggcacttcctgaaggatggaatcagaatgcctgtcatcctttgaccaatttcagcaggcccaaacaggcagactcatggctggccctcatcgaacgtggaggctgtacttttacacataaaatcaacgtggcagcagagaagggagcaaatggggtgatcatctacaactatcaaggtacgggcagtaaagtatttcccatgtctcaccaggggacggaaaatatagtcgcggtgatgataagcaacctgaaaggcatggaaattttgcactcgattcagaaaggagtctatgtgacagtcatcattgaagtggggagaatgcacatgcagtgggtgagccattacatcatgtatctatttaccttcctggctgccacaattgcctacttttacttagattgcgtctggagacttacacctagagtgcccaattctttcaccaggaggcgaagtcaaataaagacagatgtgaagaaagctattgaccagcttcaactgcgagttctcaaagaaggggatgaggaattagacctaaatgaagacaactgtgttgtttgctttgacacatacaaaccccaagatgtagtacgcattttaacttgcaaacattttttccataaggcatgcattgacccctggcttttagcccataggacatgtcccatgtgcaagtgtgacatcctgaaaacttaagaaatctggagaattttctgaagatgtaaccagatctttccaaatacaaagattagataaattgtcttattgtactttatgtagagagaaaatttcagcttctctacccaagtatgaacaagggtgaaatttgtgttttaaaaataaaactccttatcatgcccagctatttgaa

SEQ ID NO: 263526 - DNA, 1142 bp, Homo sapiens
taagcataaaataaatttattaagagataataaatggacaaaatattctccaggaaagccagggatcgactttagaggctagcaccagaaacgattcccaggtcacaccactggattgctgttttggcaccactaaaatggcagtaaatccatgaaaaaggaaagtcataagctgacaaatacagcaggggaagagaccagcagtagcagtttggaggccagaaaacacataaattactactttaatagactagggaaagttgagatctatgtctctggcatgaaaacttcaaaatttggctgattaggacgtcaagaccctaaaatagttcaagaattagagataacatttacttctgaaccaggaggtgggtttgggggaaaggagtatagaactaagaacaagagaattcatcgaaaatctgtataaaaagcagttacagccttggaaactgttccccaccccatgtagcagggtgactgctgattaggattaagcgcttattctacggagagacttcaaattctgggatattaggcataggtgagagcagaaatagtacatgccaacaccacaaaacagtgagaggttccatactgaaaaatctacatgttgaatggtaacgatcatagccccccccccttctttactctgattctaattccctggaggatttctttccaggaagcctaaagaggctaaaagaaaagtcctacagatagaattgacggtacccactgaaatagcccagtttcataatcatacagtgaagtccagcaattgataaggcccatccaggatatggtttccaatcaatttcttgctacttgaaaattaaatgggaataagagaggaagatcactaaacacttgaggaatgtctcaataggaaagacagagaccaaaacaagcaaacaaaaagtggacttcagaagaaacagaaacaaatttcaaatgaattttctaactataattaaattccttagctggccacagtggcttaagcctttaatcccaatactttgggaggctgaggtgggaggatcacttgaggccatgagctcaagcccagtctaggcaacatagcaaaatcccatctctacaggaaaagaaaaaggctttaaaaattccttaaagagttt

SEQ ID NO: 263527 - DNA, 694 bp, Homo sapiens
tctcgatctcttgacctcgggatccgtccacttcagcctcccaaagtgctggaattacaagcgtgagccaccacacctggccagcattaggttcttaagcagcacaaaccctattgtgaactgcacacataagggatctaggtcgtacactccttatgagaatctaatgcctgatgatctgtcactgtctctccttacaccagatggaaccatctagttgcaggaaaacaagctcagggctcccactgattctacattactgtgagttgtataattatttcattatcttacaatgtaataataatagcaataaagtgcacaataaatgaaatgtgcttgtatcatcctgaaatcatcccacccaccccagtctctgaaaaaattgtcttccacaaaaccagtccctggtgccacaaaggttggggaccattgatatagaggattttgtgatggatgctatctgggaaataagaggagtcaaggataactccccataataggagaaacattagagaatgtggaatcacacaaataaaaaaaaaagttttgaagaagtagaaatgatcaattttcaattgctgctgagagatcaaacacagtaaggactaaaagctgaccactgaatttgaaaatatagagcagattggcagccaaggtaagacaagttttggaggagtggtggaaatggaagcat

SEQ ID NO: 263528 - DNA, 170 bp, Homo sapiens
gttaattgcagcactcttcataatacccaagatatgaaaacaacttcagtgtttgctgataagtgaatggataaagaaaatgtgatgccacattttctttacacaatagaatatatatttctttatacaatagaaattttatgcaaagaatacacatacacacactacat

SEQ ID NO: 263529 - DNA, 479 bp, Homo sapiens
agatttagctaagtttatgctttctacctgaaaatgaaggaatttgacagatttctctggtacaaagggaaaatagcccagagtttccgctggaatgtttctgtttactcacagaggcagaatccttgccatgcagcctctcttgtgctgtgcctgaggctagtcttcgatcctctctgtaaactgagggcttccattcactagtggctatagagcttggcagctccgttatgtgcccagctctttgcaagggcatactgggaaatgagtggagataaaggacccaatcataagcattttacagtatggataccccattttaaaaaggtaaactgaggcacaatgcaatttttttttttttttaaggagtttatttgagcaaacagtgattcatgaatcaggcagcaccaaaccagaaggaggctttgctgaagaaggatgagggacaagcatttataaagtgaatgtagatgtaatac

SEQ ID NO: 263530 - DNA, 524 bp, Homo sapiens
gctgcagcctctcatgccttttgattatggtgctgatgaaagcggtggaagcagctcttctctcagcatcggctactccactttgcaaggcctgcgtttgggttgtgcttttcaagtaaggagatgttgctaccctgggaatcacatcaatgtgttcttaatatttagggcttattggtacatgcctgctgactcagtgaaggtcctattggatgacaaaaacaagcagaccaaaaactcaaagggactgatatggtctgagtggccacagcttgatctgggctcattttagaggcgctgggctgtgctgccctgtcccaggctgcttgctgcacacagctgttgggcgctggaagagtggagagtcgagcggaggtgggtgccgagttgaaaacccacaccagatttcaaagacaaaacaaaggaaaataactcatgaatagtttttctatggattacatgttgaaatgctaatttttagatatttaatatattaagtgaaataaagtaatattaaaattggt

SEQ ID NO: 263531 - DNA, 474 bp, Homo sapiens
cagaaaagaagagtcggggacctcctagccagttacattccagaggatgaggcgctgatgcttcgggatggacggtaagagcaaggagtggctcaagcctgagggttctgcggttagaggctcaatagacttttttttttttttcctttgagacggaggtctcgcggtgctgcccaggctgccctcgaactctagggctcaagtgatcctgcctcctcagcgtcgcgattagctgggtttacaagcgcatgccaccgcgccgggccaaacagttttagatggcagcccaactcagaactatttttcattatattcattatcttatttctcctaggaaagacctgctttgtggcatgttataatgtctcattgacataattaacatctagcttacagtttttcttgttgcagtcatttgattttattattctgagtgctggaaggattgaaataaatacaggttttattgctaaa

SEQ ID NO: 263532 - DNA, 926 bp, Homo sapiens
tttttttttacattaagtgtgaattgtctaaagcttagaaaattcaaactgcaaaataatgtcaaagaaaataatactggctttatcttaaatgttattacatggaaatttttttatcaaatacgaaacaaaactgtagtaagcaaaaagaactcatcagattcttaataatttagcttaattttctatctctgtaatttcctccaaaatgtgggcaccaacatacacaacacatcttgcttgttattttttcttatatccagtaatagggagtttcagagaagtggatttttctcaataaaacatgacaatctaaaggtgttaacccccccttgatttttaaaggaaatatagtgggaatatattaggttttacaaagcatctgctaaccaaataccaactgactacttaattccaggaaagccttacggcaccatttttggcaactgcgaaaaagctgaaaacaaattttatgttccctgccctcagaggtcctcctgtactttctcctaattgtttcacaacatgttaaaagcctgaaatagccaactcaattacacaggctacaagcatcccctttgaacagatatttgatccttcttcaacatcaagtaatacaattaactcattgtcacacactaaatcaataatacacagcagaacagaatgggcaataatcaataaccttaacaagaatgcagtggcatggctcagtaaatcaaactgtaaacacataactcatacccagaattagactataacaagaacagttacagacgctgtcaagaaaaacccagaactggccataggatgtttgtttccccctttacacttgctggaaaaagtacatgctctcctatttctaatgatgttaaaagtctcaaactcataaatgaggcaaatgctttttaaaattttggagctag

SEQ ID NO: 263533 - DNA, 293 bp, Homo sapiens
cgttttccatataagtgaatatggatgtgattattatttttagtgacttcatagtattcgaatcccattctatgttagtaccataaaatgaccagagcccagttgctggctattaaaactgcttccagccttttttgttgtgcataattctgtaccctgcccttccacgtagatctttccaggcatggtcattgccttagaacacattccttgaaggagaattgaccattgtgatatgtgtttgaaatgagaacatagagattttgttctcatgtgccttgcccattgagacc

SEQ ID NO: 263534 - DNA, 590 bp, Homo sapiens
gggtgattttttttcacatgttcaagtttgagcgcctcgagggcctgtgaatggctgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctcaaaaaaaa

SEQ ID NO: 263535 - DNA, 477 bp, Homo sapiens
  misc_feature (19)..(19): n is a, c, g, or t
  misc_feature (35)..(35): n is a, c, g, or t
  misc_feature (45)..(45): n is a, c, g, or t
tcctggtttttaaaattgnctttataagatctcgngttttcttanatctgatggtgatgaaaatgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctcaaaaaaaa

SEQ ID NO: 263536 - DNA, 385 bp, Homo sapiens
aaatctgttgcttatcatcatattttccagagaatggagcaaccccacttgtcatctgttcactcagtatccatctatgctgttggttctgtaagatttcccttgagattaaaatgttgaaagacagcttcattctttccgtgctccagtccttttcataacacctgctccataaatgcacatcactcaagtggaattgtaagtcgtccagttctcaagtgatctgttttagaattttaatttgtaaaataaaaacagtttatgtaatcctttcaccataccattacccaactaccttatctgttctgttatttatttttccctaggtattttgtgtaaatctggtttgataaactgtaaaaatggcaaaacatacatttaaaga

SEQ ID NO: 263537 - DNA, 382 bp, Homo sapiens
tttttttttgccaatttaggtatactagttttctttaacagaattcaaaatcgttcaatactggagaatcatctttgcaatactggagaatcacctttgaattagaataacggagtgacaggacttaactacctaactggaacacatctgtaaaaagaatttggaaggggaaggtgaattttaaaagaaaaagaaggtgatctgattgtatgtcctgggaaagttacttagcctttctggagctggtttccagcctgtacaacttggaggattcttgggaggattatatgagataacatacataaagcatctaccaaagtacctgataaatggcagctattatcattatgtggaatattaggggataaaagaacttgagtag

SEQ ID NO: 263538 - DNA, 253 bp, Homo sapiens
atctccacgttcaggagcatccctgtaactggacagtggcacagagccaccgctgcacacagcagtaaaaatgtacagccctccctctctgcgttcaggagcagagggcatgagtttcacctccctacaggacaggaaactacgacagtcatctttgcacctgaagaaacaaattatttaaactttctcatcctgcagtttacttcttagacatgtctactttctatagcaaaatagatctggacacgaataa

SEQ ID NO: 263539 - DNA, 582 bp, Homo sapiens
tttttcttttttgagatggagttttgctcttgtcacccaggctggtgtggaatggcatgatctcagctcattgcaacctctgcctcctaggttcaagagattactctgcttcagcctcccaagtagcggggattaccggcgcctgctaccatgcccagctaatttttgtacctttagtagagatggggttgcactatattggccaggctagtctcaaactcctgaactcgggtgatccacccgccttggcctcataaagtgctgggattacaggtgtgagccactgtgcctggccagcaatgaacttctaagagaaatcagatcaagccctcaaacattaatttacagtcaagagacaatctctgaattcagccctccccgtcccccagcactggtattgacatactgcagaccttctattgttggtggcaaatatgagcaggttaaggcacttttcgggattagagaatcttcaaactcaatatgcataagaacaatttatcctgatgaccagatataatagattctgttcattaaggaaactgcttgccatttgctactatttaacccattctttctatt

SEQ ID NO: 263540 - DNA, 535 bp, Homo sapiens
tgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagatgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaag

SEQ ID NO: 263541 - DNA, 553 bp, Homo sapiens
  misc_feature (4)..(4): n is a, c, g, or t
aganagtcggcaccagatgaagaaaatgaatcacaagtcaactgacagtccaaaggctccacagctcagaggaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgacactgaactaaagaaccagaaaatagaggggtgtattagtgaactacagaaaattcaagtcccaaaagctgtaaatactctgaggaccaaagaaaatacatacgttgttcagatttgccctgaggggtcagtttgtacccaaacatttgctgccacaagtagtaaatgtagaagcaatgcaatatctactattttacttttctttcagggttaatcaagtgccttgttataattcttcaaactaaaaacattattataataatgaaaaatatttctgctgaacttccgaataaaaaaatttagtaat

SEQ ID NO: 263542 - DNA, 606 bp, Homo sapiens
acactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatacatacgttgttcagatttgccctgaggggtcagtttgtacccaaacatttgctgccacaagtagtaaatgtagaagcaatgcaatatctactattttacttttctttcagggttaatcaagtgccttgttataattcttcaaactaaaaacattattataataatgaaaaatatttctgctgaacttccgaataaaaaaatttagtaat

SEQ ID NO: 263543 - DNA, 282 bp, Homo sapiens
agctgtacctttctcctttccccatgtcccttgatctctctttggaaacgtgcaccgccttggagtgcgcacaggaggcccctgaatagagagaataaagctaaggggtagtggacagctgcggctagcagccgtagggggagcagaagatctcgtggccagaggcagatctatgacaagccccctgcccaggctgcctataccgactgctgcaggacctctgcctggggggtgcagctggcttgttagccgggagggacaattgggtgagggatgcagaag

SEQ ID NO: 263544 - DNA, 346 bp, Homo sapiens
tataccaagtaatgggattgctgcgtcaagcggtagttctaagttctttgagaagtctccaaactgcgcacggccagtcttttattttaattggtgacttaaaaatcagctggttgttgttacagaaaacagtgctaattctaattttgtgtgacatccgtagccatgttgaaactgctggatcaaatcttgttgggtgaaaaaagctgccatctatgtcctagtcttttggaactgtatttatatagcttctcggggacatttacatatatttgagtttgaacatacttatgggactggggttctgaatcagacctgcttactaatcatatggaactagccaaga

SEQ ID NO: 263545 - DNA, 398 bp, Homo sapiens
tggacaggattgggtgaggatgggccccagatttaaacaacaaagggcactctttctgcgaagttctacagtcagcaattctattaggagtatcccatttgactccagatttcattctgcaagacaactgattgacttattttctcctaatctaattggtcactaaattcttccaattctttgatttttgaacctcaattacagctgacccttaaacaacactggttcaaactgcatgagtccacttatatgtagattttcttccatctctgcaaccccagacagcaagccctccacttcctcttcaccttattcaatgtgaagatgacaaggatgaagatgtttatgatgatctgcgtccattcaatacacagtgttttctctttatgattttctta

SEQ ID NO: 263546 - DNA, 292 bp, Homo sapiens
ggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggtgtctgct

SEQ ID NO: 263547 - DNA, 610 bp, Homo sapiens
gcattaaatcttcttttgtttctacaaaggctccccaagggttggctaaccttagagatgctatgtctcttgcacctgcagtcacttatcccgctctatcaagcttgcacttggccagcccatctgcccctcctgctgaaggtgatgcatgggatccatgctcggactgttgtaaaccaagttctgtgatacgtcaattcctggtgttgtcctatttgaatatcctaaatttcccataagagttgttatgaatgtaacatgtaaatttactatcactgatgattcctctgaagaatttcatgcaaccaccagaaggtgcaagatcctagagatctacatatcttaggcattttccaggagtactccttcaactgtcgccctgcacctgattaagctggatatactatagtaaaacaatatgtaacagatccatgcactacatggtgttattgtggaaatggccctgacacatggccactcacttgacagctgtacaaaagacagttatgtttttgcctagaggacgctaaggttaaaattgtctttattgctcatcttccccactgatactgagcacacctggcatagctgagattaaactatgagtatg

SEQ ID NO: 263548 - DNA, 441 bp, Homo sapiens
tcccctcctcccctaaggtaccctccccccctttattgggcagaatttgcttggtgcctgggaccaaccctgcagggaaggcttttctctggttgttgtgaggattacaccctcctgctcttcacctcccctcggctccccctacagcgggacacagtgggcttccataattattattagtacataataaactttatcggtaaatttcttgtttgaaaccaatcagctcgtttccgaggtatgttggattttcagtctaaggtgaaaatgtacagaaagcagttcctctggataattttttttagtaatgggagagttgtgatgtggtttgtggtagagatctgagggcgttttctcgtgtgaatgagggtttgatgttgcttaatgtggtgggtgtattttcctcgttgtgtagtaattagtatgtagagagggtccagg

SEQ ID NO: 263549 - DNA, 462 bp, Homo sapiens
tcccctcctcccctaaggtaccctccccccctttattgggcagaatttgcttggtgcctgggaccaaccctgcagggaaggcttttctctggttgttgtgaggattacaccctcctgctcttcacctcccctcggctccccctacagcgggacacagtgggcttccataattattattagtacataataaactttatcggtaaatttcttgtttgaaaccaatcagctcgtttccgaggtatgttggattttcagtctaaggtgaaaatgtacagaaagcagttcctctggataattttttttagtaatgggagagttgtgatgtggtttgtggtagagatctgaggaggaaatgtgacgccggacgcttccctgtctttgacctttttaaaggaagaggaagttcaccgacattacccatcacccacaaaagtctcacttcttggaagatttgtgttaggc

SEQ ID NO: 263550 - DNA, 110 bp, Homo sapiens
ggttggaatttgaatagtggagtagtgtctgccacagtcaggggcctggatgaagtagaccaccagtacggagctatactcaggtacttttcaatgtatatatcttcatt

SEQ ID NO: 263551 - DNA, 462 bp, Homo sapiens
acctcaatactgttttccataatggctatacaattttatattcccactaacagtatacaggggatccaatttctctacattcttgccaacactagttattttctgttcttttggtagtggccattctaatgggtgtgagatgatgtgtggttctgatttgcatttctctaatgattagtgatgttgagcatcacttcatacgcctattggccatttgcataccctttttggagaactctctatttgaatcctttgcttattttattatttggcttgtttttttttccccttgtgttgagttatagacgtttcttatatattctggatattaaccccttttcagatatgtgatttatatatattttctattctgtgttgtcttttcactctgttgtttcctttgatgtgtatcagtaattctttttgtaaataaaattgtattggaacactactatgcctaat

SEQ ID NO: 263552 - DNA, 783 bp, Homo sapiens
ctgtttcatctaaaataaaacattcattaaccaatattatataaaaattttaatttttgtcatgggctacagtatttattagcaatagaaagagatgagaaggccaagataatcagaagagtagttaagtctgaagtagtttctggcacatgagaaaacactcaatacatttactactgttaactgcttttattttcatttctgggtaattttgatgtaggtataatgaaacctgctttcgtttgccattaatagtttaaactggaaaaaatcctttttctctttccagaaataattatgaaatagccttgatgtggcctgttcccataccacattctcaaaccaaaaaatttttagcattagtttttggtttggagactaaagataaactgtggcaacttatcaagtttgttgtattgatcttatacatttagttcttatcaagtaatagtcttaaagtacgaatgacacttttcaaatttgtgttctttaattagaatcaagaggggaataattttataaatcctatcaaaagctttatttacatgtcattgtgttaaatcagaaggcaaatttattctctgtgaatttttgtgaaacttttgagaccattacttgtgatatgtccatgtgtttgtacttttcttacttgtattctcatagcctagagcatgtggtttacttttcagctttcaaagatttgcccctgtttaatattgttataaatatcttaaagtttcccatcattttttattggtttggagctccattttaatgccatct

SEQ ID NO: 263553 - DNA, 373 bp, Homo sapiens
agtattttaagtggatactcacaatactcaccttctagttggctcagcagtgaacagtatttgcacagtcataataatataagtatcttctattttatttattctcctgccacactgaaagtgaagacaaggactttcttttactcatctttttttttaatctcctttgttattttgcatgaagtaatcatacaacaaatattagtcaaattaacctaaagtttaatagttcattgcataatttctcaacgttattgactctctttaacttcataattcttaaacgaaataatgatgcgggatacttctggttaacatacaagtgagtatccccatccagaaaggcacatcaataaagaggaaaccacccaaa

SEQ ID NO: 263554 - DNA, 807 bp, Homo sapiens
ttcagtatacagctggtgttttgattgatacagtatagaagtgacaccacatattattatatcagtctgatttaaagagctgaaagaaggtgtttatggagtaaactacactgcataaacttttttttcatggctcttagtagaaaaataacaacagcaacgaccaaaatatgtacacaaatgcacattttatatttcatagtcagacattaactaaaccaataaaacaatcttcaaagatttttattgcataaaaacaaaatataactttctagttaagcattaagctcaacaaaggaaatgtataaaaatgaaaaaacattttagctttgttcctagcactgctattaactcaccgtgatattcattaaaccaaaagtcaaatatatgaacagcaagggccactgggcattgcaagtctgaaatggtgtgctagaaagtgttttgaaatttaaaggaaaagaaaaaaaaaaaccttcccgacaggtgaaaataagcctcctattcagttatgatatctaagaaaatttaatggaattattaaaggagcacttacagaatatgtgcaattactttctttagatgggacaaatatatttcataactgatttcttcatttccaagaacagttttatttctttgatctttctttcatgataatgaggtagatgtgtacaggattgaacattacatttcaaatgtaatcccaacagacttgcaacaagcaaattttttatgttattctttataaaatgatacctctgtttaaaccactcactttcttcaacatactatgaattcatatat

SEQ ID NO: 263555 - DNA, 467 bp, Homo sapiens
ggtgccccctctgggcccaagttccagcatctggtgtttccaagtcaggccttcccccagctcttgtctcacaggagatatctgacccatagggctggaggggactcctcattggccacccccctcccccatgcccattgtgtgcagtgggaggtggtctggcctggcccggcccttgggagctcccaaagtcctggtcttcctggaggaggggccaggcatgagggtattgaaagaggaatttgaggccgggcaccgtggctcatacttgtaatccccagcactttgggaggcagaggtgggcagatcacgaggtcaggagatcaagaccatcctggccaacatggtgaaaccccgtctctaataaaatacaaaaaattagccgggcatggtggtacaggcctgtagtcccagctactcaggaggctgaggcaggggaattgtttgaaccccggaggcggaggtct

SEQ ID NO: 263556 - DNA, 210 bp, Homo sapiens
tgcacaatgagtttaagtaaattgcagaagggttacatcctgtgaggtggagctaagagtaggcctttagtttctaatccaatgcttttgtactaatgatataaaaagctcttggccgggcgcggtggctcatgcctgtaatcccagcactttgggaggccaaagcgggcggatcacgaggtcaggagatcgagaccatggtgaaaccct

SEQ ID NO: 263557 - DNA, 237 bp, Homo sapiens
ttccctgatatgtatctgctacttggtagcagtaatgaaaaagaataatctgacaccaaaggtctgaagttaacttctagctggtcttctctacccccaggtatcaattctatattttgggactcattagcacaaaatgaaaaaaacaaccagcccaatttcccctatacccacaccaaatgggcaatgatctcaactactatttaagaaagttaaatgcttaaaaagtcttttaca

SEQ ID NO: 263558 - DNA, 517 bp, Homo sapiens
tgagacggagtcttgcactgttgcccaggctggagacagtggtgtgatcttggctcactgcagtctccacctctcagattcaagtgattctcctgcctcagcctcccaagtagctgggattataggtgcccgccaccctgcctggctaatttttgtatttttagtaaagatggggttttgtaacattggccaggctggtctcaaactcctgacctcaactgaactgcccccatcgggcttccaaagtgttgggattagaggtctgagctactgggcccgggcaaacttggaaacatttttttccttcctagtgcctcagttttctcaaatgtaaaatgggaataaaatatctaccttgtaagacttttgtgagggtctaataactgttatatacattatctcatttaatcttcacaacaacctttaaaatagggatacgatcattctcaatttacagttgagtgaaagtgaggcagttcagatggcttgactaaggttacctggcatttgagtggca

SEQ ID NO: 263559 - DNA, 292 bp, Homo sapiens
tgtgtgtgtgtgtgtgtacatgaatatttctatgtaaccatacatgcgtattttcttcttattttaatgagtggttacagaatatagacactgttatataccttgctttttcacctaacaccaaatcttggaaattattctgtattcctagaaagaaagcttttgcacttttaaaatggcatgcgtctacagtaggttaaagtaattcctaatgcgtggattaggcctattacataatagcactcaagaaattgttactgcctgtagcactgcccaagaacacggaaaaaaa

SEQ ID NO: 263560 - DNA, 288 bp, Homo sapiens
cccagctactcaggaggctgaagcaggagaatcacttgaacccgagaggtagaggttgcagtgagctgagattgtgccgctgcactccagcctgggcaacaggtggagtggagaattaggctgtacaaggctggtgtttaactattttatggtttggtaacagaaagaaaatatttactaactgggtatggcacatttttgtagtcctagctacttgagaggccaaagtgggaagatgacttgaacccaggagttcaaggccagcttgggcaacacagcaagagaccc

SEQ ID NO: 263561 - DNA, 395 bp, Homo sapiens
aatgaagagcaaataatactagcttctatttgtggagtacctcctatgtgctagacactttaatacctaattctgatcctaacactaactcaacaattttgttatttaccttatattatttcctttgttctccttcagatgaagaaactgaggattagaaaggttaaataacatattcagacacaccctgtcaagtgatggaaccaggattcaaagcccattctttcttgtccaaaccatgttcgtttcaagtcagaggataagatagaaaatacagtaattgggcctggcatagtgggtcatacctgtagtcccagcactttgggaggccaaggtgggttgaggtcaggacattaagatcagcctgggcaaaatggtgaaaccccgtcgcttac

SEQ ID NO: 263562 - DNA, 273 bp, Homo sapiens
agtgggatggggttggagtggaagggaggacaggagacacgggccaggaatccaggcccaatcagaagagccgcactggggctggcgctgacattcaggtggtacctactgtgtgcagacacccctcctccactttatcaaggtctctcacttcacatttctttcttgttttagagagagggtcttgctctgttgccgaggctggagtgcagtggtgcagtcacagctcactgcagcctcaacttcctgggctcaggcaatcctcccacctca

SEQ ID NO: 263563 - DNA, 409 bp, Homo sapiens
ggacaaactcagagtttgcactggacagcaaatttgatggctgacataatcagcaagcgttcaataggttggaaagctgccaagataagtgcattatgagcacaatgagtgttgtgtgatttcattagaatagaaaaaacaaatatctacatctttgacggagtgtgtgcctctcccagttgtcccttgagttgctgctgatgagctctttagtgccccagcccctcattaatgttaaattctttgtaattggcagagggaaccatcgagacagtactaatggatcctggcagaagtagcagtgtcaggtgctgtaaatgagaaaacctaggcggcgacctttcagaaaagaggcaggcaaaaattaaaaccctcaatgattcctctacctccatggaaacaaacagtt

SEQ ID NO: 263564 - DNA, 559 bp, Homo sapiens
aagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatt

SEQ ID NO: 263565 - DNA, 423 bp, Homo sapiens
ctaagcatcagaagcacatagaatttgcaaaagtaaatttgacacgtacttaatcataatgcataatttttattgtcctgaatgataattaggaatctgtagtaagacattttttaatgactgcaattatattattgttataaaatcaaactgtttttctctcttttaaaaagttagttttcctgatatttttgaatataaatgataaatattaagtttatctgactctataggcagtttaaatttgatcacactcataccaactaacgcatttaaaaatccaaaatcttggatttctactttacagacttataaggattaaattgttcaagtttatattgttgaagatgaattatgtctctcaaaccttttctcttatttttgagccacaactcaggacaagcaagatcacactgctcctac

SEQ ID NO: 263566 - DNA, 383 bp, Homo sapiens
cctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccgtgctgcctgccctcagggacctataaagcccactttgctacaaaca

SEQ ID NO: 263567 - DNA, 2429 bp, Homo sapiens
cctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggtagcgggagccagcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccaggccgtgctgcctgccctcagggacctataaagcccactttgctacaaaca

SEQ ID NO: 263568 - DNA, 2184 bp, Homo sapiens
cctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccaggccgtgctgcctgccctcagggacctataaagcccactttgctacaaaca

SEQ ID NO: 263569 - DNA, 965 bp, Homo sapiens
cctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgccc

SEQ ID NO: 263570 - DNA, 414 bp, Homo sapiens
tgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgt

SEQ ID NO: 263571 - DNA, 2532 bp, Homo sapiens
cctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggtagcgggagccagcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagtgcctgacacaggacaggagctgcacgagtttgttgagtgagtttctggctgtgaacctgtgaggctgagtgcacgaacgtgtgggcaggtgtggctgtacagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccaggccgtgctgcctgccctcagggacctataaagcccactttgctacaaaca

SEQ ID NO: 263572 - DNA, 501 bp, Homo sapiens
cttttcacttctctaggattaattttcagtaatggaatgactgggtcaaaggagatcaacattgctgtggctctttcaggttctcttaaattccatggattttaactttggcccatgacctccttgacctctggaaatgtgacatcctgcacctgctgcatcagggctcttccctggtcttgcctacacttgtgtctacacagcttgataaaccagagggatagtctgagagagaaactgaaggtcaaaatcaacgcagtggtgccgaacagaagggcccgaggtgcgatgagtataatatgaacacgaaggaaaacagcgagttcagaagcctggagaatcagaagcaggtcaagcgctggggttcagggcaaagaccctgaacactgtgaaggtgttggagacctgttttgaggtggcactgcggctcaatgtgagtgcagacctgagagattaaagtgcctacgaagggccaaatacctgtcccttcatgacatgact

SEQ ID NO: 263573 - DNA, 183 bp, Homo sapiens
caatattggtaaataaaatggattactatcaggctttaaaaactcttccttttgccaagttattctgaaataacttcttagactctaaagaaaattagccttgctctgggacttggagagagaggagccttcagtaagtaataaataacctatccaggtggtcacctccctttccaaccgtcg

SEQ ID NO: 263574 - DNA, 333 bp, Homo sapiens
aagacaaggtacattgatctgcacacaggaggtgctcagcgacgccagcactgatgggctcctcctgccttgagtgaagagcatctgcccctggacagtgaacaaaaggtggggccattttatgcctccaacaagacatctggctcaaactcaacttcaaagattagagtaccttgtcttttctaactagtgctttcaagaaactttgaaatccagttctagtcacattcccaccatgaaatcttgtttgccagtgatcacaaggttgtagcaatattaactcaagcctacctggctgggaccttggcctcgccacccccatcatgtcagtcg

SEQ ID NO: 263575 - DNA, 339 bp, Homo sapiens
atttggatttttcaaagacaacatctaatcatccccagagaaatttcagctgagaagacaggatgatgaagtgccctgggggccagagtccagacaagtattttggcacctccaaggactcgcagaacacagagaggaaaagagagaccctgttatctttccgcaggggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactggtcattaaataa

SEQ ID NO: 263576 - DNA, 666 bp, Homo sapiens
agctcagatttttgaattgggaggggaataaaaattatgagggtccctcaacacaccattgggccctgcacagagctggagagatggagtggcagtaccagggcttggtttgctgcctgattccttataactatcttctggcaatatccatgactcattgccagcctcttctgtgctagcaaaaagtatcccaaatgccagaagattgacaggcctgtcccatttataaaacccatggatgtcttctagcacatagcacagaatggtgttttgctctggagtgaataagaagccaaaaagcagattgggagatatcttttctttctggtcttcctactcacagggagccctgtggattaatgggttgttttttcataattggtgatcaatttcaattttctttgacccagatacactcccctcatcaatggcacacataattgttggctggagttggggtaaaatccatggtctgtgagccactccagtagtcttaaaatagacctccgttttgcttaagctagctggaaagaatttcacttagttacagcaaaaatagtgttaaaactaaggttaccatgccaattcattgtttgcattagtggattaactatttttggagcctcctaatgactttgaataaattgtatttgataagagtaatga

SEQ ID NO: 263577 - DNA, 893 bp, Homo sapiens
agttcaagagtttatccccacccggggcagtggggagcctggtgcccattcttggagggtgtcccatgacaggagagatggaaggcacttcctctcccctcgagcactcactcctctccacaccccagcatcaccagaggccagcgggaaatgtcttggaccaagcccttggacacgggtgctgggtccagtggaaaatatctgcctcagggtccagggagggctgggtaccaagcagccagagcagcctgtaaaagggtcacagctctggaggtgggcaccccatgggcggtggggatgggggtgcacttctagctccgccaccttctgactgtgtaacctgggacacagtacttcaccatcgagcctgtttcctcctgtcgaaagctgaattcccattcctgctttggagcgttgttgtcagggttaaaacaggaaagatcaagtattcagtacctgcctcacagtctgacttatagatggggctctgaaatgacccctttcctgtatgcaccacatgaatttgacttcaatcaataaaacaaactccactctagtctcccatagatagagtgagcgagctcaccctcctcctccagccaccttccttttcccaggtcctccacattttccccgtgccctactgaggacagagcacacccctcagccattcaggaccccccatgagtatctggctacctgtctctagcccccaagtgactcattctccctgaacaaagcaggccctatctttgtcccccagtgcatccttcaaggcccagatcatccgctgcctcctctctgaagccgcccccagatccctgagggagaatgaatcacttgctccactgtgctccgacagttctgagctcattctgctttgtgttatgggt

SEQ ID NO: 263578 - DNA, 196 bp, Homo sapiens
atctgcacggccaagactgagtggtggatggcaggcatgtggtctttggcaaggtgaaagaaggcatgaagattgtggaggccatggagcactttcggtccaggaatggcaagaccagcaagaagatcaccattgctgactgcggacaactctaataagtttgacttctgttttatcttaaccaccggaccattcc

SEQ ID NO: 263579 - DNA, 537 bp, Homo sapiens
acctgattgacggtgctgattatgatggcttaatacagctcatcgtcacttcaccgggacacgtggactttgtgggcttcacagactaccccccaccccccttgtttgtggtacagttgattcttctgctaagtggaggttgattatttctttattcattatctctttaaaatgcaggagaaaagggcaaattatcaaataggtgatgattatcctagtggaagctctcttgggcagagtcaaaagaagaacttgcagttcaacttgcttgatacctcatagttgattcctattcattctgccgttgaagggtttcagatgatacgacttaattttagctgttgtggaacagcaatgaaaatccatcgcaagaccccctttcttgatgttagggaagccgggggacgcaggatgaggtagtaggctccagctgctgcccatgtgaatgatttttcctctgcagatagatgggtcatggtccctttctagatgagcagaagattattctcacattggagaggtaacattaaatacatt

SEQ ID NO: 263580 - DNA, 484 bp, Homo sapiens
acacacaggaagagggtcagatgagaaactcatagactcttagagccatagctattccttaaagctggctaatgggtttatgggggttgattttactattcttttctcattttgaacatattgaaaattttctatattaaaacatttttttaagaaacaaatgtgcaggttttgattgagtggatgttggaaaggagaaagagtgtctttaggacaaaaggaagcacggttttgtacagtaagtcagacatttaattacacaaaaagctgatatatgctgataatatacattgattcatatagcacgtagctaaatttgtgaattacaggtacataacttcagagaaacaaggatggtttggatttattttgtctgtttccctcccctgagaaattcgtatgaccttgccttaaaacttttaaagaatacatttttaaatctatattcctgctaaagaaaacagtgaatcattaaaataccacc

SEQ ID NO: 263581 - DNA, 1059 bp, Homo sapiens
aaacctcatttaccagccattccaatctcatcatagcatggcatcatctgaccttttttctgctgtttattatgagtatttctaattttaactttcaattttcaccatcttccagtcaatttgcaactaaattatttccagggtgaggacactatcactggacaactgggtgcaaatacatcttgaaatgcaatgaagctaaaccattgattgctatcagaccccacgtaaatatatagtccaggcgtaatctgattgtatgctgtgcatgaagatttatcttgattttttttcaatccacatacggttcatatgaatgaacaaattgcaccttattgcaaaataacccagttttaatttagaaataaggtcaaggatgttatggaaacaaagtaaaaataaacaaaaaaaatacattctatttcaactgtggatagagatgcatgttttataccttataagtaatttcagaaatttcaaattcagaaagaaatatgaaagcaagagtgattccatgcagatcaaaattaaaatataatttaaattacatcatgacaataattttattctcttggggttcatggtagatacagaattaatgcaaagttttcatcagattatactgatactactgatttctagatttacaagcactagaatttatttgagttggtacatttgtcttcatgtatatatatatgtgtcggagaaatttaggttatttctagatatttgaaaaaataatttatgatatttgaatttgaatgaacttaaatccaagaaagactggaaagtttcattacactgatttaaaaatgcccaagtatttgatatcgaaagatatgtcaaaataggaaagtcataattcctattaccttgtcataattaagtctggaatcaaaaaatatatgtttctttctcaaagctgaatatactttggaatattgttttagaagtgttaaaaaacaaacatttaagaaaactatgatattttatattttcaaataaaacttactgcttaaagtgtcaaaccaagttgtataaaatcattgccattta

SEQ ID NO: 263582 - DNA, 458 bp, Homo sapiens
tttctacttgcagacttccaaacatttactgaaaccttaaactcttactgattctttaaactgtccccattccagttttctctacagcaagtagctctcaatgtgtagtcctcagatgggcagcatccactggaaaactgctaggaatgcacattctcaggcctcacccaagatctgctgaatcagaagctctggggtggaacccaacaacctgcattttaacaagccttccagatgactctgaagcatgctccatactgacaactaatgcaatgcattatgtcttcatgtgaccagcagcaccaactgcaagactgtctgtcacctgagtgtgacttgcaaccaagcacatgtgggaattcagtgaaggcccctgccttgacctcattatcaacaggaaccagccaaagacagtggtcactctttatccatgtaaatagacaccgtaatttattttc

SEQ ID NO: 263583 - DNA, 738 bp, Homo sapiens
ggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagccaaa

SEQ ID NO: 263584 - DNA, 1227 bp, Homo sapiens
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagttgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggacagaggtgtgggagacccaaggtggtcttgagattgacagacagcaagtccttggagatagcccccgagtccaagaacttaggcaggggccccaagacaataaagttggtctctacta

SEQ ID NO: 263585 - DNA, 125 bp, Homo sapiens
tttggcggggcagtcggaggagagctggggccaccgagcagcccaactccagggaaagaccatcacccttatggctcctcgatctgctgagagctacttccactcaataaaactttaaactcatt

SEQ ID NO: 263586 - DNA, 294 bp, Homo sapiens
agttttcctgcaagtgactgtgtcccttgaccaaaagtcattgctctcctcaaagaatttcctttataagactgtctccttccaggtttccccactgctcccttcccttgtccctttgagccatacaagccccacatgatggtactacttccctaatctccacacctttgcaatttctctctttattaaatccttctcaaattatccaaatttggctatgccatttgttcaggacccttcttgataaagcatttgtctctaaaaatatgcagaagccaattgtggtagttcacg

SEQ ID NO: 263587 - DNA, 406 bp, Homo sapiens
ttctggtcaaggaattgaggtggaggctgaaggtcttgttcttcaggccttgtcatgtgcaatggcctaactgccaccaggggaccctccctcattctgtcccattggctgctcacataatctttaatgcaccctggtcctagctgtcctgggcctcagaccaccccaggaactccctagtggttgcagtgtaaagtacacattccttttgttcatttccttggtccttccaccttattttctttttttcttctttgacacagggtcttgctttgttgcccagggtggagtgtggtggtgtgatcatagctcactgcagcctccaactcctgggcttaagtgattctcctgcctcagcctcctgaggagctgggactgcaggttgcaccaccacatctggctccag

SEQ ID NO: 263588 - DNA, 375 bp, Homo sapiens
actagtcttgttgactgactgtattaacatggataatgaacgtgacaatcagaaaggttttggttagatgtgaaaaccagggtaaaacgacagtttcagaggcaaatgttgcaagtgcctatccaaaccgtatccatgttatcattaaacattggaagcatataagtaatcttccttgttctggctccatgtttaacaagcactcttccgagcatggtttttcttcacatgtttttatttatattgagaatatgttgggcagacactctgagtgtccagtccccttatgttcttactgtgagctggcactttattttcatgatagcaatctcatatgcgctgtctcagggatgtctgtatttccaagtgtaatgg

SEQ ID NO: 263589 - DNA, 393 bp, Homo sapiens
ctagctctccctcacaggagagttcttatcgccgtccccgaccgcacggcacttagcaaacgcggactggatttgaggcctggaggatcaggcggagtttctgggcgtattaactccagcggcagagcagccaaggaagggggcagggctgccaggacaaaccggctgaaaatggcagaggatgtgctcccattttatccggctgcacagcgtgcatggattgggcccgaggacaagggaacaacctattaaaatccagagagtcaactgcaaaatgtggaaccgaggcctggagggtttgctaggagagggaaacgtttgcagggaagacagcccttcctttctcgcaatttgcttcccctaaatgtctgaaatacaaaactcaacaaacaa

SEQ ID NO: 263590 - DNA, 438 bp, Homo sapiens
cagattgggtaaaatacatgtttattgcatgtctggtagacatagatgtggccaggagaggaaaggggaagacgtaaatgtaagttatattgagaggtgagagagataactgatggttagtactgtggttttccccctataaaagaacatataggctgggtgtggtggctcacgcctgcaatctcagcactttgggaggccgaggcgggcggatcacctgaggtcaggagttcgagaccagcctggctaacacggtgaaaccccatttctgctaaaaatacaaaaaattagccaggcgtggtggcagcacctgtaatcccagctactcgggaggctgagacaggagaatcgcttgaacccgggaagtggaggttgcagtgagccaagattgcatcattgcactccagcctgggcaacaagaacgaaactctgtcaaaa

SEQ ID NO: 263591 - DNA, 462 bp, Homo sapiens
  misc_feature (18)..(18): n is a, c, g, or t
tctcgaggatccccgatngtgaataggtaggtatcataagatttagtccagagtcaatttgagaagaaattactttagtgatatgaaatgaaaccatgctatttagtcagaatacttctgagagtatcccctgtccaagcatttgctgaatttctatctactaattttcaggtggaacagtatggttgcagagagtccatttggacatagatacactttcatgcattcatgtctttaacaataatttgtggccctactgtgtttgttcactaactcctttgaacctaccacacaagctatatgtgtattttccttgtaatttgggaggtccaatgcttcattaagctcacatgcctgaaactaatgaagaaaatagctcgttaaccagctagtataaaagtagccaccaaatcaagtcaatcacctgccttaaatcacacagtattcccatcttgagcggag

SEQ ID NO: 263592 - DNA, 463 bp, Homo sapiens
gcaggtggctaagtacaatcagaacaagtaggtatcataagatttagtccagagtcaatttgagaagaaattactttagtgatatgaaatgaaaccatgctatttagtcagaatacttctgagagtatcccctgtccaagcatttgctgaatttctatctactaattttcaggtggaacagtatggttgcagagagtccatttggacatagatacactttcatgcattcatgtctttaacaataatttgtggccctactgtgtttgttcactaactcctttgaacctaccacacaagctatatgtgtattttccttgtaatttgggaggtccaatgcttcattaagctcacatgcctgaaactaatgaagaaaatagctcgttaaccagctagtataaaagtagccaccaaatcaagtcaatcacctgccttaaatcacacagtattcccatcttgagcggag

SEQ ID NO: 263593 - DNA, 697 bp, Homo sapiens
acataaggtctaggtacgaggctgggtggcgtttgtcttttttaataagttaaagtaatcagttctaaagtaaaaataaaccttatctcataaacccaagtttatgtgtcagcctgggtgcgcatacctggatttaatctgatgtctagtgccttgtaagcattctaagagatgacctcaggctgggtgtggtggcttacacctgtagtcccagcactttaggaggccgaggtgggcagatcacctgagttcaagaccagcctggccaacatggcgaaactccatctgtactaaaaataaaaagtaaaatagttgggcatggtgatgcatgcctgtaatcccagcttcacgggaagctgaggcaggagaattgcttgaacctgggaggtggagattgcagtcagcctagatcacaccattgcacttgcacccccagtctgggtgacaaactccgtctcaaaaaaaaaaaaaaaaaaaaattggggggctaaatgtgggggggggaaaaagagcttgatgaacgtgggcacatgggccataaggaggtccctgacccaattttgtgtgtaccaagcgggtgcacactcggcggggtccccgaatagggagaccaaataagctcgaaaaagccgggttaaccctggatcagaattctgcgacaaagaaagaaatccgtacaacacgcgaaaaacagcaa

SEQ ID NO: 263594 - DNA, 430 bp, Homo sapiens
agggagcagcctggtctctgatgccccaggacctccctggccctcctgctctgcgctccttcctgggaggagaaataagctcttgttgggttgaagtcacttgtccctcagggttttgctgctgttacttccagctaaacctactcccagctaatatttacaaccagagctgtttccatcacaccaaactggaagaaatatgtctgtgaagggaaagcatgacccacactgatgggagggagaccccaggctccctgtggaagcaagaaatggaaagagaattcaattcttagtagctacaggccaagctcaccttcagtcctccctaaagtgaaaattttatatgtgcatgtgtgtgtatctgtttgtgtctgcacacatatataaagaggtcagttcctgtccaaataaaaagggaaaatatgtggat

SEQ ID NO: 263595 - DNA, 474 bp, Homo sapiens
ccgggggttaggggattccacagatccccaagaaactctgtgtctcatgatcctctgtcctcctgaggttccaggaggctgcacacattgtaatccacaccctgagtggggagggagagaggaggagaatcgcaggagctggggccccccttggtttctgccatccaccccatcgggaattttttctagtgtctggtgtcaacagggagcagatacaatatttttccaaataattaaggcagagtctctcccccttggcattcagggctgggtcgttctctggggtggggttgtcctggccactgcaaggttctgatcagcatccctggcctccacccactccacgccaggagcatccctgagtcataacagtcacaaatgcccccagacaccacctagcatcccctggggaccagaaggacccctggttgagaaccacggttgtatagaaaggaattgaagcaaaaaaaaaaa

SEQ ID NO: 263596 - DNA, 292 bp, Homo sapiens
gcattttggtcagaaattatttattgtaatatttctgctttatggaaattgccagtattttctttgtgacctactataggatcagcatttataactgtgctgtgattgcttagatgtatattctccataatcaaggtctaaagtttgatatatatccatgagatttactgtatttattatgttgcttagatcttctgtttcttattttttgtaaataagtgatctgttttgtactaaggttatactaagagttgtatattaaaatctactgtgtcctgtgtttccatgtatc

SEQ ID NO: 263597 - DNA, 914 bp, Homo sapiens
agatgccaaaattctacacagacaaggtcctttatagagtgtatttggaatcagctctcactggaccagctccagctaagtgccctgtgaagggcactaggatttcagagatgaataaacattgtccctgccgcggggggtgacaatctcattgaccctgcagtcattctccatctgcctttatggtacggcatctctgttcaccaaaaacaccatggttcaagccctgtgatttagcctgtagaacgctaaaagactttctctacttccttattgtgacagacagattccattaaagcatccacaaccctgaagctctgtttctcccccactgcctccccccaagaagtaaaagaggatgattattaaaaattacaagtgccaccttccacactccatctcccaaacttcatttcacaatggctgctgacatcaataatgtcagacaggataatcaagtttgcataatgtaacagttctccaagggtccctctgcacaatcacccctcccagcctgcatatagggaaacagaccttagattaggcagaaaaggcccttagactgtcaaacacaagagtcctttctccacatgcgattttacaggagttagcctccatcagaaaagctgacttctgattccagtttgaccctttattggcaggaggacaggggcaaatcattgaatcatcctgtgcctcaattttctctgctttaaagtggaaataactctgtagtattctaaaagaatgtcgatcttgaatggcatatatgtaccatgtaattgatgaagtttattaagaataaaaatatggtgatagttcaataagttactttgtcaacttaatatttgttaacatacattgccaataatttatttggaaaataactaatatttagtaaaatagaacaacag

SEQ ID NO: 263598 - DNA, 218 bp, Homo sapiens
aatatctttttgctttaaaataagaataattaaatggaatggctgtttaagtagaaactaagtaattataatgttaatgacatgtgcagtaagctaataatttagtcaggtgctgagttgaatgacatctagggttgttttttctcccccacatcttttttttgatttgccacccattaattaatcttccctagttagtaactaacaaaaaaaaataa

SEQ ID NO: 263599 - DNA, 412 bp, Homo sapiens
cagattcagtatatatgaatcagtatgtatgaataatgatgttcagtgatgggcattgaatagcgatgaaatgcccagtgccaggagctttcaagagataaggctcactggccgggtacggtggctcatgcctgtaatttcagcaatttgggaggccaaggcaggcagatcacctgaggtcaggatctcgggcagatcacctgaggtcaccaggctggccaacatggtgaaaccccgtctctactaaacatataaaaattagccaggcatgatggtgtgcacctgcagtcccacctactcgggaggctgaggcaggagaatcacttgaacctgggaggcggagcttgcagtgagccgaggtcgcaccattgcactccagcctgggtgacagagcgatgccatctcaaaaaaa

SEQ ID NO: 263600 - DNA, 548 bp, Homo sapiens
agctgttttagtaaaccaaaaaagtgtttactatatcagcttggaaacatgctttgtttccaggagataaaaggtagagctgacaagatgctttcctttgagtaaagacattatgtcacctatgaaatgttagtagatgcagagcaatgctgataaggtgtgtagtcttagactactgaaataagaaatgtaacgtcttcatgttgccgcattttaagagcataatgaagcaggtaagtggaaatgcttgtacctgaaatgtgtattttgaaaatcagattcaattaagtgagctgctttgacacttaattctagattttccagatgaactgaagtgtgttgctgtgtcttgtgatgcttttccttcagtggctctctcttatatgtattttagttggtgtaactttgttttgattcatgccaatgtgacttaagtctgaaaatatgtcagtctcacattatgtatttttctgaccacttagtattttaaagacttctacttgttataaaatcacaatttggaataaatgtggtaaattttagcaaaa

SEQ ID NO: 263601 - DNA, 781 bp, Homo sapiens
gagacagagtctcgctctgtcgcccaggctggagtgcagtggcacaatctcggctcactgcaagctctgcctcctaggttcacggcattctcctgcctcagcctcccaagtagctgggactacaggtgcccgccaccatgcctggctaatttttttgtatttttaatagagacggggtttcaccgtattagccaggatggtctcgatctcctgaccttgtgatccacccgcctcggcctcccaaagtgctgggattacaggcgtgagccaccgcgcccggcctcctttactttttttatctagtttctcctacagatctataaagagttgttggcagctctagatgcactgcctatgacttagccctgctctgcatggagcagttaaaaaaaaaaaaaggagctgttgattttttagtttgttcagcttttacttgttgttatcatggagtggtgacttccgagcttcttttctgctggtctggaaactggatgtgtatatcttttcaaagcagtaacaagaaggtcaatgaggccagagcagagtagtgagtgagggggagagcgttatgaaatgagattggagaggtagccagggtctagctcatgtaatagtgttattaggcatggagagattttgtgttttattctaaaaataatgagaagctattagatagttttgagcaaaggtgtgacatgttctattttaggttttaagagcattgctctggcttttgtgagagtaaaccacaggaggttaagagtggaagaaggaagatgaa

SEQ ID NO: 263602 - DNA, 721 bp, Homo sapiens
ggacgttcagagggtccccgtcggatgcaagtgtcacataagtggagagctcaggaacagggactgtagcttatctttttttttttttgagatggagtctcactctgtcgcccagggtggagtgcagtggcgcgatatcggctcactgcaagctccgcctcccgggttcacgccattctcctgccttagcctcccgagtggctgggactacaggcgcccgccatcacgcccggctaattttttgtatttttagcagagacggggtttcaccgtgttagccaggatgatctcgatttcctgaccttgtgttccgccggcctcggcctcccaaagtgctgggattacaggcgtgagccaccgtgcccggccggcgatttccactttctagcaacagttggcgtagaaaccctggcccagccagcgacagttagccagcgacagttggggaatatctgtttatcgttatttctactttgattcctcaaaaggtgattctgttttgacgtgaaaaaaacaacccaactttggtttatgaaccagcccaactctgacaagtgtgttcctgttccgcctacatcagttctaggttctctaacttcagtgtgcagaagattcaaccaaggaagttcctgggctctaccccttgagattcagttttaataggaaccgggcttgatgctattagccccaaggcttttgaaggggatctggggctgccttt

SEQ ID NO: 263603 - DNA, 899 bp, Homo sapiens
aagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagccaggtatggtggtgtgcgcctattgtcccatctacttgagaggctgaggcaggagggattgcttgggctcaggattttgaatccagcctgggcaacatagcaagaccccatctctaataaataaattatgttttgggcattaatgatgtttgtctattctgatttctcaaattttatttaggtctttcatagcttttttatttaaaggtatatgattaagataaaggaaaagtaaaatgaaatgtttatgtaattttatattctcaaaattttctttaaatttgctctgttttctgacagtgctcaaagtgggaatttttttagaagtacggttatcaaaaaaacacatttcctatgggacacacatttcaaagatgtttagtacgataaaatttttagtaaaagggtagcacttttaagtcatttgaatagaatatttgtgtaatatttagtctagtgttagtccttaaatctgccaacaaaaccagatagatgtcttaaagtaggcacatttattccattgtgactgttaagaaataataaaagattaaatta

SEQ ID NO: 263604 - DNA, 801 bp, Homo sapiens
aagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagccaggtatggtggtgtgcgcctattgtcccatctacttgagaggctgaggcaggagggattgcttgggctcaggattttgaatccagcctgggcaacatagcaagaccccatctctaataaataaattatgttttgggcattaatgatgtttgtctattctgatttctcaaattttatttaggtctttcatagcttttttatttaaaggtatatgattaagataaaggaaaagtaaaatgaaatgtttattcctgcaagagctggttgttaaaaggaacttggcaccaccacctcctctctttctcgctccttctctgtgtgacatgccttctccccccgtgccttctgccatgagtaaaagctccctgagacctcaccagaagctgagcagatgctggtgccatgtttttacagcctgcagaactgcaagtcaaataaacgttttctttataaggta

SEQ ID NO: 263605 - DNA, 1413 bp, Homo sapiens
aagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagccaggtatggtggtgtgcgcctattgtcccatctacttgagaggctgaggcaggagggattgcttgggctcaggattttgaatccagcctgggcaacatagcaagaccccatctctaataaataaattatgttttgggcattaatgatgtttgtctattctgatttctcaaattttatttaggtctttcatagcttttttatttaaaggtatatgattaagataaaggaaaagtaaaatgaaatgtttatgtaattttatattctcaaaattttctttaaatttgctctgttttctgacagtgctcaaagtgggaatttttttagaagtacggttatcaaaaaaacacatttcctatgggacacacatttcaaagatgtttagtacgataaaatttttagtaaaagggtagcacttttaagtcatttgaatagaatatttgtgtaatatttagtctagtgttagtccttaaatctgccaacaaaaccagatagatgtcttaaagtaggcacatttattccattgtgactgttaagaaataataaaagattaaattaacaaaaagcattttaaatttttatgatacctatagaaaattgataatgaagatgaaaagtaaataacctttctgataatattctactttacacatatactgaaaacttacttacatatacccaaattcttctagtgaagaagtttgtaatatggtttgagtatttgtcccctccaaatctcatgttgaaatatgatccccagtgttggatatggggcctggtgggaggtgtttgggtgatgggggctgatccctcataaatggctttgtgccttccccagtggtaatgagttcctgctgtgtttattcctgcaagagctggttgttaaaaggaacttggcaccaccacctcctctctttctcgctccttctctgtgtgacatgccttctccccccgtgccttctgccatgagtaaaagctccctgagacctcaccagaagctgagcagatgctggtgccatgtttttacagcctgcagaactgcaagtcaaataaacgttttctttataaggta

SEQ ID NO: 263606 - DNA, 726 bp, Homo sapiens
tacagcctgaggggcacattcattagtgagatatgcacataagtaactatcaaaatgtcagatggtcagtgcagtgaacaatgcatggtagtctaggaatttaacagagtgaaaaggacagagaaaatggcaatagggctgcaacataaagaatgggtacgaattgtctgaagacagtatgatgattaggaatatggcaaattcgaaggccagagcaagaaagcgtgctaattattcatttattcagcaaatacttcctaaatgcctcgtatgttccagttaccatcaggtgctggggaatcaggtgaacaatactgacaaagtccctatccttccactagtctacatcctagagaggaaaacaggtaacagataaacataaatacctgataaacacctcagacagtggaaaataccattaaatatacacacacattttcagataaaagagagtaggggagcacacagtggcagtcaggtggccctctctgaagaggcagcatatgcgcggagagctgaaggaatgacacaggccttacaaataagtaatggggaacgtgccaggcagagggaacaacaaatgcaaaggccttgagaccagaacgaagcaaggaggccagagtgcattcggtggagagcatataggatataagagtgaagggacaggcaaggccaaactaaaaagggccatataggctgtgatgagtacagatatgattctggaga

SEQ ID NO: 263607 - DNA, 418 bp, Homo sapiens
ggcatgagcactgcgtctggctttttttgctttttaatgatagccattctgactggtgtgagatggtctctcattgtggttttgatttgcatttctctaatgattagtgacatggaacatttctttatatacttgttggccacatgtatgtcttcctttaaaaagtgtctgttcatgtcctttgctgactttttagtggggttggtttttttttgcttgtacatttgtttaagtcccttatagattctgtgtattagacctttgttggatgcatagtttgcaaatgttttttttccattctataggttgtctgtctactcttttgatagtttcttttgttgtgcagaagctctttagttagttagttagttcgttagttagttatttagttagttagtttatttttgagacagagttt

SEQ ID NO: 263608 - DNA, 177 bp, Homo sapiens
ataatacctatttttatcttaggtactgttttgtagcattggctatctttgtctacataaaattctaataaatattttctatgcacgaaatagacctaaaatcaaagttgaacaaatgttgcaattttctgtacctcacttttagatagaccttatttatattgcatgcgaactcag

SEQ ID NO: 263609 - DNA, 434 bp, Homo sapiens
ggggctgatggtgatgacctggaagacactcagtgcacacagccctgcccactctgtgaacataaaacacaaatttgcatccaatatcactgagggaatctttcaacccaaaagcagccattgtttgtgggattcctttagagagtataaccaaggagttggctatggtcaggtgcttgagaatcagatctgtggactgtaacatacctctggtgaaacaaaggaaactatagtggtagagaagaaagaaattccccaggaatccgaccatgatctgagataataagatcatgcctattgcaaaatccttggaggccatttgtcatttttcagtgactgataattacattcaaagtgagagaaccctgtgtggaaacataaagtttcacttttgcaaataaaatccactattgtacacttaccattgtttccaa

SEQ ID NO: 263610 - DNA, 655 bp, Homo sapiens
tgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcgggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatc

SEQ ID NO: 263611 - DNA, 487 bp, Homo sapiens
atcctgtttagatggtttcctagaaacatgattgtttattggcgttgatctcgcagtctggtgagaacttctttactgataatgtcaagttcagtttatcctcccaaccaaggagcattcagcacagaacaaagtcgttctcctcctcactctgtaaagtatacgtttcccagcacccaccaccagcaggatccagcattcggaggcaaacatgaagctccatcctctccaatttcggggcaaccatgtggagatgatcaaaatgctttaccttcaaaactttcaaacgaagagttaatacaaagtatggatcgtgtagattgaaaaattgcaaaagtagaacagcagatccttaaactgaaaaagaaacaagtaaaagtctttgcctaatatattctaagaatgtatgtttttctccctacagaagataattttgagttttccatattttgaaactttacataaaaggaatcatgccttacgtatt

SEQ ID NO: 263612 - DNA, 303 bp, Homo sapiens
gtcctcccgcctaggtctcccaaagttctgggatttacaggcgtgagccaccaccacacccagcctcttctctgtctttaactttgcctccgcctccaaattccaattccttcagcaattgctgggaagggattactttttgcacaattctgtctggagccccttgcaggcaggagcttgtggacaaaagcttcagcctttgcgggcctggcattcctcatactatttggtcacctgcttttttcactttgtgtcctgaacatttttctgtattcttttttttttttttttccacctcctagg

SEQ ID NO: 263613 - DNA, 351 bp, Homo sapiens
tatggagaaaagtgtgagcaaatgtggggccctaatacagaatgtcagccaggaagacgaggaaggcagacctccctagaacagtggtacaagacattggtggtcatcttaacagatgtgcactgactgatatccttcagaataggaaggaaatgtgagatcttaagaaggaattctaggggaggtctcagctttaccccctgtgacttgcacttggtcagtatacaacttattcttcccaccagagtgatagaaagaaaaaaagaaactgagttctgtatgttgagaaatatcatcttggcctttaaattattttaaaattatagcaacatgagtcttcctgaaacttta

SEQ ID NO: 263614 - DNA, 418 bp, Homo sapiens
cctcttaaccagaaaattgtctcactacaaatatagcctaaccacttgctcaaccacagtcttctttccagtttgaatgtgtacttaaggagagcaaactgggggaaaataaagttgaaaattgtagtacaggcatcagccactgcttaaaggcttcactgaagagccattagcagccacacagcaggaagcaaaaggtagagagagtaaaaggggccaaatagagtaaatagaaactatccataaatgtctctcctggggttaattatgctgccagaattttcatatggaagaacatcagctcattttgatacttattttaagaaagggataggaggcctataaaatgtgtatcaggagccttattcaataatataaatctctgaaaagaaaagcttaagttttgtggttgtttaaa

SEQ ID NO: 263615 - DNA, 309 bp, Homo sapiens
tcaatactttcaaagtcaccattgaaagaagtttctgaaaatatctatgggcatattcaagaagtgcactcagcctgtcttctttaggttgtttacttctacttttaagagctagataaatattttaagaaccctagctatttactaaccctcaactccagaacagtaacaaatgctacctacattatttggagcaagttttgagaactgggtttcatgtttgttattaaatttacctatagccatgcaatagacccatcactgttaattattaccattgagcaacagttctacaatacagataaatac

SEQ ID NO: 263616 - DNA, 421 bp, Homo sapiens
agaccactttccttgagaaagaaaacatgttttatccatagcttcagtaatgaggccactaaaatattaattttctgagcattcttaaacataactgaatcagcttcaatttgcctggatagatagacattttagtggcttatagcaaaatgtaataaactgaataactgtaggctttaatgtaatctcacacaatcctattacatcccaattacttatttgacctttttaaggataattcctgcctaaacacacacaatcctgcaattccgaatgtcttcttcccgtgttgttccaaggcaatcaatagatcagaaagaattaatatcttgctgtgtcctccatttgtaatatacactgtcccaggaaggtataatgcatccctcccaggcataataaatgtttattgagcactgtttgt

SEQ ID NO: 263617 - DNA, 529 bp, Homo sapiens
aggtgctgcaggctccagagcccaggtgctctaacaggaagcagacagctgctgctgggtaccgggttcctgcgtgcctacctcccggctccacgctgtctcctgctaacagacccagctgtcccagggcagcctttgccgctcactctcagtctgtgggactcagtggcccaggaaaggggtggaaggggacacgactggacctgggcaagcagaaaaccacgccttccagcccaaagagaccggtccagtccacagggctctgaacgcctgctgggaagagaggatctctctctccctctgctgggcttggatccaggctcgcggcaggggccaccacgtagaaggctacctaagaagcctgcctaagaacagaccaggccaggagaggggagccaccaggcactgcgggtggcacataagccccgtcattcactctgccagggcgcctcctccatgctggagtggacttcggccccggggacacagggcaccatatgcaccagcacccagtcacacctgcggccgc

SEQ ID NO: 263618 - DNA, 101 bp, Homo sapiens
tgggattacaggcatgagccactgtgcccggcccgacacagctccttttataacaaatattttgtagtgtaccttaagtgaaataaatactataatttact

SEQ ID NO: 263619 - DNA, 387 bp, Homo sapiens
ctagagaaaggcttagatcgcagtcattctcttggctttgattccagatgtttgtacagactcagtaaagtgaagtctctgtcctctttcggggcaaaaccataggattgtccatctctgcttttcattcctccccaaacccgctgcctgctgctcctctcacacttttctttcgagtcttcccagcacttgcttaagaataccagtggcaagaggcgtgcagcccatgaagaacagtcctgggtgaaagctgggctggcagggggaagaaagcgcaggtggatttcctccatggcttttgcttttccccattcacctgtgcttatgtaatcacagcctggagttttcaggaataaagcgactagttatcactgctggttacacggg

SEQ ID NO: 263620 - DNA, 1188 bp, Homo sapiens
tgtgaatgtgctgggcctgctgttaatggtgcttgctcccagccctttgacttcaaagctggaagaaggccttagagattgtctgaaagcaactgaggcaggaagaaagctctgtacccaggattacacagtaagtggcagagccagcactcaacctgagctttcagagcctgttcccagtgctgtttctacaaggccactgtctctgctactgctggggatcccgaatcaagctcacttcaaagaatgtagctatgagagcatgaaaccgtgcgctcacgccgcacacgagttgggtaaatggagcgcctcattttccagatgtgttacagaaactgtgctggaggatgtgactggccagtgagacaactagggggaactgggtgattcaggctgtttcaacactgacttcttcaaagtccaacaatcagagaagcagtttagtcatcgggattttctcacatcacaccattttttgatctggaatgctttcttcatactttgacttgtatgtgatttatttaggattggtcaggagagaagagaaggaatgcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagccca

SEQ ID NO: 263621 - DNA, 759 bp, Homo sapiens
cgcgcgtggaggcgggcggcgggcgcacagcagcagcccgggcggtgggcagccaggagcccccggcccggcccggcccggcccgccgagggccccagcgcaggagccgcgcccggacccagggcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagccca

SEQ ID NO: 263622 - DNA, 698 bp, Homo sapiens
tcctaattggatggagctggggggcgtgagcaccagcgtcagatcggggccctcaggctaccgcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagccca

SEQ ID NO: 263623 - DNA, 2044 bp, Homo sapiens
caaagacaaaataatttactagggaagcccttactaacgacccaacatccagacacaggtgagggagaagaaatttcctgacagccgaagagcaacaagtatcatgatggggtgctggattttgaatgagggtctctccaccatattagtactctcatggctgggaataaatttttatctgtttattgacacgttctactggtatgaagaggaggagtctttccattacacacgagttattttgggttcaacactggcttgggcacgagcatccgcactgtgcctgaattttaactgcatgctaattctaatacctgtcagtcgaaaccttatttcattcataagaggaacaagtatttgctgcagaggaccgtggaggaggcaattagacaaaaacctcagatttcacaaactggtcgcctatgggatagctgttaatgcaaccatccacatcgtggcgcatttcttcaacctggaacgctaccactggagccagtccgaggaggcccagggacttctggccgcactttccaagctgggcaacacccctaacgagagctacctcaaccctgtccggaccttccccacaaacacaaccactgaattgctaaggacaatagcaggcgtcaccggtctggtgatctctctggctttagtcttgatcatgacctcgtcaactgagttcatcagacaggcctcctatgagttgttctggtacacacaccatgttttcatcgtcttctttctcagcctggccatccatgggacgggtcggattgttcgaggccaaacccaagacagtctctctctgcacaacatcaccttctgtagagaccgctatgcagaatggcagacagtggcccaatgccccgtgcctcaattttctggcaaggaaccctcggcttggaaatggattttaggccctgtggtcttgtatgcatgtgaaagaataattaggttctggcgatttcaacaagaagttgtcattaccaaggtggtaagccacccctctggagtcctggaacttcacatgaaaaagcgtggctttaaaatggcgccagggcagtacatcttggtgcagtgcccagccatatcttcgctggagtggcaccccttcacccttacctctgccccccaggaagactttttcagcgtgcacatccgggcagcaggagactggacagcagcgctactggaggcctttggggcagagggacaggccctccaggagccctggagcctgccaaggctggcagtggacgggccctttggaactgccctgacagatgtatttcactacccagtgtgtgtgtgcgttgccgcggggatcggagtcactcccttcgctgctcttctgaaatctatatggtacaaatgcagtgaggcacagaccccactgaagctgagcaaggtgtatttctactggatttgccgggatgcaagagcttttgagtggtttgctgatctcttactctccctggaaacacggatgagtgagcaggggaaaactcactttctgagttatcatatatttcttaccggctgggatgaaaatcaggctcttcacatagctttacactgggacgaaaatactgacgtgattacaggcttaaagcagaagaccttctatgggaggcccaactggaacaatgagttcaagcagattgcctacaatcaccccagcagcagtattggcgtgttcttctgtggacctaaagctctctcgaggacacttcaaaagatgtgccacttgtattcatcagctgaccccagaggtgttcatttctattacaacaaggagagcttctagactttggaggtcaagtccaggcattgtgttttcaatcaagttattgattccaaagaactccaccaggaattcctgtgacggcctgttgatatgagctcccagttgggaactggtgaataataattaactattgtgaacagtacactataccatacttccttagcttataaataacatgtcatatacaacagaacaaaaacatttactgaaattaaaatatattatgtttctcca

SEQ ID NO: 263624 - DNA, 819 bp, Homo sapiens
gctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaat

SEQ ID NO: 263625 - DNA, 454 bp, Homo sapiens
gaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttgataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaa

SEQ ID NO: 263626 - DNA, 666 bp, Homo sapiens
catccaaccaacagcaggacttttgttaatgtcccccaaatggtgcacaccatgaccattcacaggcttgaataagatctactgttgagtattttctatccagatgttctgatctgtttgagaaaatgtctgtgtttataaacactcgtgcatttcatggaaaaaggtttttttctgatattgtttgttaatgctatttaaattttgtattttaggtgagtacaaagccccactggcagcaggcagctccatcattccatttgagtgtaaagcaggatgatgagagtccagaaccatttagtgttaaaaatgaacagtcccatggtaagaacttcaatattctaaattagatttaaggataatttgtagagagagaccagacaatatttagttaatagtgtaatagaagtacaaaacctgaatgacattaatgtcaagtagaaaaaaattttcccaatacatcttccctcagaaaataattgattgtagttctcagttattttaggctgttgtaaatgctataagagctgatattttaggaattgggttgttgatactaaaacgtttatttattgtggtcagaatttgcctctacatcaaagactgagatttttataagagagattttaataaattatatttctttttaaaattttttgtgggttt

SEQ ID NO: 263627 - DNA, 626 bp, Homo sapiens
tgcttagcaacaaacgctgcccggacgctagacggctctggtgcggagggagctgagaccgctgcaagtcccggggccctgcctctatcgtcctaggggttccgcgggcaggagcaacccagaagcaccggtgaggccagcgcgtcctcgcagccatgagcagtgagcaggataaatcggccagcaaagaaaaatccaagaaaccagtaagatttctaccacagctgtctatggtaatttaccaatataccatcatacttcattcctttatgataatgtttgtttactacttttcaagcttgaaagagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatg

SEQ ID NO: 263628 - DNA, 806 bp, Homo sapiens
  misc_feature (774)..(774): n is a, c, g, or t
cccgcgaggcagggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgtacccagtaacagagggagcaaagcaaatcttatcctcaaagaactgcagctgcttgttagatctacctggtggttccatagagaaactgctcagagaacctgcctttacctcgcctaaaacagaactatcccggagctcagttcatcaactcaggatccagtagtgtaatacagaagcctgttacgagatataaggcacttcgccctcggaaatctcactgtcggaatccttggaaatcacaccacgcacaacttctatttcttcataatttgcaaagaaccagtgtgactccagtcaagaacaaaagattaattgtgaattagcgaagaactctaattttttcaagcagccacatggaaaacgcattctaatgaaatcctttccattgctcttttttcttagttcttcaataaagcatgcgatttgatcacaaaaaaaaanaaaacggcaaaaaaacagaattctcaggggct

SEQ ID NO: 263629 - DNA, 1011 bp, Homo sapiens
  misc_feature (979)..(979): n is a, c, g, or t
cccgcgaggcagggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgtacccagtaacagagggagcaaagcaaatcttatcctcaaagaactgcagctgcttgttagatctacctggtggttccatagagaaactgctcagagaacctgcctttacctcgcctaaaacagaactatcccggagctcagcaaaggagtccattcatcctctataactgctatacaatatctctgttaaaatgctgagaagatttatcctaaaagaaggcaccaaagcaatggggttcatcaactcaggatccagtagtgtaatacagaagcctgttacgagatataagcaattgtaatgaacagcataactatttgtgtgactacacttggtataattctattaagcatggagattgcaacttttgcattaaatgcaaccacatacaattggtcaaacgcacttcgccctcggaaatctcactgtcggaatccttggaaatcacaccacgcacaacttctatttcttcataatttgcaaagaaccagtgtgactccagtcaagaacaaaagattaattgtgaattagcgaagaactctaattttttcaagcagccacatggaaaacgcattctaatgaaatcctttccattgctcttttttcttagttcttcaataaagcatgcgatttgatcacaaaaaaaaanaaaacggcaaaaaaacagaattctcaggggct

SEQ ID NO: 263630 - DNA, 1028 bp, Homo sapiens
cccgcgaggcagggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgtacccagtaacagagggagcaaagcaaatcttatcctcaaagaactgcagctgcttgttagatctacctggtggttccatagagaaactgctcagagaacctgcctttacctcgcctaaaacagaactatcccggagctcagcaaaggagtccattcatcctctataactgctatacaatatctctgttaaaatgctgagaagatttatcctaaaagaaggcaccaaagcaatggggttcatcaactcaggatccagtagtgtaatacagaagcctgttacgagatataagcaattgtaatgaacagcataactatttgtgtgactacacttggtataattctattaagcatggagattgcaacttttgcattaaatgcaaccacatacaattggtcaaacgcacttcgccctcggaaatctcactgtcggaatccttggaaatcacaccacgcacaacttctatttcttcataatttgcaaagaaccagtgtgactccagtcaagaacaaaagattaattgtgaattagcgaagaactctaattttttcaagcagccacatggaaaacgcattctaatgaaatcctttccattgctcttttttcttagttcttcaatcaaaagcagcatgcggaccggaatgtcgaatactttgatgatcaagcgtgagttagttgcatatctaaccaatacacaa

SEQ ID NO: 263631 - DNA, 788 bp, Homo sapiens
  misc_feature (756)..(756): n is a, c, g, or t
gggggatgaaggacgccaccgaggaagcagaccccaccgggctcccgaggctgccaggccccccgctcagggcgctgcctgcagaaccacgcccccctgtccctgtgctaagagggtgacgcgagtgcccgaagccctggcctggttaccattcgcgactccctcgtcctgggttctcccattgccaggaatgttttactagtaaccatggtatagttgagacgatccactcttgtcctacgcatttcggcacaatacaggcgtctaggaggcttacctggcattgcctgagagaatcttccatccatttaagtacccagtaacagagggagcaaagcaaatcttatcctcaaagaactgcagctgcttgttagatctacctggtggttccatagagaaactgctcagagaacctgcctttacctcgcctaaaacagaactatcccggagctcagttcatcaactcaggatccagtagtgtaatacagaagcctgttacgagatataaggcacttcgccctcggaaatctcactgtcggaatccttggaaatcacaccacgcacaacttctatttcttcataatttgcaaagaaccagtgtgactccagtcaagaacaaaagattaattgtgaattagcgaagaactctaattttttcaagcagccacatggaaaacgcattctaatgaaatcctttccattgctcttttttcttagttcttcaataaagcatgcgatttgatcacaaaaaaaaanaaaacggcaaaaaaacagaattctcaggggct

SEQ ID NO: 263632 - DNA, 486 bp, Homo sapiens
caagatggacaataaactagtaaattaaaagaaattctgaaagcaataaatgttatgtagagaattaaggtatcaggtactattttagagtaggaaagaacatccctctgagatgagtattaagctgagatgtgcatgataaaatgttatcagccaggtgagtgttgaggggataacattgcaggccagtggaatacattcacttatgaactgtggctctctgccacctcatttcctgcttgcccagcgaccatggaccagctctgatctgagtgtcctaggaaacttctctggaggttgcaactacaccttctccaacaagacctgaaccccaccttggaatccccacttcaaccttgtccttcattgcatcatttccctgagccctaggctaaccagcagagttctctttacatccttatatttacttccctgccatatttaataattctttacattaaaaagttcctgttcaaattacaaaga

SEQ ID NO: 263633 - DNA, 413 bp, Homo sapiens
gaagttacaaaagatggaccttcatccttctgcaacccttaggattaagggtcctcttgtaaaagggaggggaaatatgtaagaagcattcaaaccagagcgactccattttgaacaagggctaagaaaaatgaagctgggtcctgttgggctgcatgcccaggaggttaagcattcttagcctcaagatgtttacaattgagggaacagattaataatgtttcctaaacagactcaggacttaacagactcaggaacgtcttgatactttgagaacaaaagcacttctagttttaaatacgcattgtacctaggctggatgcttttcttacttttggaaatgccctaccctgtctatggagtcactattcattccctcctttattaaagttgcttctattttgcactgtgga

SEQ ID NO: 263634 - DNA, 232 bp, Homo sapiens
gctcgacagcagcttcagtaagagattctgggacaatatctttgaacagtaatttttttttttcaaatagattcctaaatgtcatttaagtagaatatgtaaacttaaaacttctggattaaaaaatagaataacaaaaaccctgaaaagctagccacagtatcaggactatggtttcatttgttatgaaacataccaatagaatttgggaactttaccagttttgttattg

SEQ ID NO: 263635 - DNA, 499 bp, Homo sapiens
tttcttcaattgtgaggccaatctttattgtatttttttgatattgaacctttctttgcaacatatgagttttacttctttttttaatatattgttaagctacagatgatctaaaatttgacattgagggggtgaatatttagggcaacttgaatttatgcttctggaaaaaaattacatgaaaaaataatgataaaataaataaggctgggtgcgggggctcacgctcgtaatcccagcactttgtgaggccgaggtgggcagatcacctgaggtcaggagttcaagaccagcttggccgacatggtgaaaccctgtctctactcaaaatacaaaaattagccgggcgtggtggtgcacgcttttaatcccagctactcgggaggctgaggcaggagaatcgcttgaatccgggaggcgggggttgcagcgagctgagattgtgccattgcactccagcctgggtgacagagcaagactctgtctcaaaaaaataaat

SEQ ID NO: 263636 - DNA, 277 bp, Homo sapiens
ccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgc

SEQ ID NO: 263637 - DNA, 351 bp, Homo sapiens
gtggccagagatcacctacaccaaacagatttttgtctttcaaggcctttgtttcccagggtgcacttcagccaacacaaccaagggaagaagaaaatgggcaaaagtgtgcatgaggtggtaggggccagactgtgcttgtgcccacagaaacaccaagcttctcccagcaaaagccccagaactgaagtctgcaaaagggaagaggcaaattagtaatcattctgtgctacagagcagccacgtctgagcattacctaatgcttttctcaattgttttgacacatgtagttttgttttaaatatgtatggtaatttttaataaaatgctgataagtgtgccaagccatt

SEQ ID NO: 263638 - DNA, 312 bp, Homo sapiens
aaacgaataaagaaattctcatttcactctcctccacactggactcgctgaagaaagagtagctggctggaggaagctatccagagggaagcagcacagcatctatgcacagacatagcaaataagagcaagtgaaccacgccacacttacgactatgtcaacaaaggaatagaagcaaaggaaaagactgacatagcttagactgggaatccttctagaaagtaagaaagaattcagagagattcctctctctagtcttgaagaaatgaaggtcttcaaaatgaagattgaagaaatatagaatatctaaa

SEQ ID NO: 263639 - DNA, 232 bp, Homo sapiens
aggagggactggagaccacccccggcagagaatgtatccccatacgggtcaccaaaattgtttgaaatgtttgtttcctggtgtcgtaaagcaatattacttgaatataaatttaattttttttagcgaggccattttttattttctgtagaaagggtgtacttgccagcagttttgttatgagagtatattgaataaaggagacagggtcatttataacctgacgtgtcca

SEQ ID NO: 263640 - DNA, 295 bp, Homo sapiens
cactttcagaggctgaggcaggaggagcccttgagcccaggagttcaagaccaacctgggcaacataaggagaccctgtctctttttcaattttataattttatataaaaaaattaataaataaaaatttgttaggcaatttagataccttaaagttatcactgactcaccccatcatataggcttagaaaagtgagttgaggttggggtcagtggctcacgcctgtaatcctagcactttgggaggccgatgtgggtggatcacctgaggtcaggagttccagaccagcctggc

SEQ ID NO: 263641 - DNA, 511 bp, Homo sapiens
tgcttttgttgtcatatctaagaatctgttgcttaattcaaggtcatgaagatttatacctatgtttccttctaagagttttatagtcttagttcttgtatttaggtctttggtctattttgagtatattttgtatattgtgtaaggtagaggaccaaattcattcttttgtgttcagtgtcctataacacaaaaaatacacattaatttgagatgaattacagatttaaatatcaaaagaagaaaagtaaaacctcattaagatacagaatatcttcataaccttggagtagtcaaagatttaatgaaaaagccaccaaaaaagcactagccattttttaaaatattaactggactttattcaaattaagaacttctgttcatcaaaagatcttattaagagagtaaaaaaagacacaccataataaacattatttacaacacgtatctttaacaaaagatttgtatctagaatacgtaaagaactctataaaccaatagaaaaaaatga

SEQ ID NO: 263642 - DNA, 308 bp, Homo sapiens
attgctctcctggggtggtgaagctgtctgcatactgtaaaaatggatgcatgacactgcacatttttcagaagccatggaactgcacaaaaagaaaaatgagccctcatgcaaactgtggtgtttcattaatgataatgtatcaatattgtttccacagttgtaacacacatatcacaccagagcaccacggtaatcataggggaatctgtgagagggggaggggggtatatgacaactctacattatctgctcaatttttctgtaaacctaaaactgttctgcaaaaataaagtctcttaattaaa

SEQ ID NO: 263643 - DNA, 384 bp, Homo sapiens
aagaacttacatgtttatgtgtttcctgaaatactaaatataattgtcattgcagttaattcttaaaaatatttgaaatgttagatttatattaaaatgtttggtgccttccacattttagtcagtagacataaattgtctgattgtgaaagtggatttgatatatgtgggatattcctgtgatgtttgttttataacaatagcttttctcttaacaaatcgtagcaactactaatataaaaattctttgagcaattaggtttaatcaacagtgtagtatggttcaatttgagtgctagaaataatttcaggtaaaagactgttagtatagtcttttgaagtgtatgtttcactccccttatggatttggtaatacccaagtga

SEQ ID NO: 263644 - DNA, 265 bp, Homo sapiens
aatttattcagtacaattaggtttgcttaatctgcctttatacctgctgcaaaattttagaaaatgagtaaacaggtttaatcacagaaaataaaacaaaatcactaccaccaaacgtctaaatctcatgcttgacagttttaggacttattttacttcctcttcaaaatggactgagaaattgcttaaagtatttaaatgtatcttttatggggctacaatactttctctctctctttcctgtattacagatttataattacaa

SEQ ID NO: 263645 - DNA, 386 bp, Homo sapiens
aaaaaaaaaaaattagccaggcacagtggtgtgcacctgtagtcccagctacttaggagtcagaggtgggcggattgcttgagcctgggagattgagactacagtgagtcgagaccatgccactgccctttagcctgggcaacataagtgagactctgtctcaaaaaaataaaaatcaaaatcaagtattcatcttaaatcacttcaaggcaaattcctcagaaaacatctgtggaaatagcaacataatcgtttttggcatttgtacacttcatttgagttctgaatatcctgggtagcttcactaacactattaaagaagttacattcttttaaatgtaatgtgttatacatttattgttagaataaaaaaattggaataattg

SEQ ID NO: 263646 - DNA, 145 bp, Homo sapiens
catctgacaagggattaatatttagaacatacaaggacctcaaacaactgagcaacaacaacaaaaatatccaattttaaaaatgggcgaaagagccaaataaacatctctgaaaaccagacgcaagtggccaacaggtatatga

SEQ ID NO: 263647 - DNA, 280 bp, Homo sapiens
ggccgcctgcctcccatgtcaccccgtgtgtggaggacagcatggagggacggctacgcacgctgcacacgcgtccatcaaatctgctttcttgttcctgccaggagccgcagagcctgccttagaacttcccccgcgatggatctaaatgatatttaaggtttgacaagttacacttgtggttttcaaaagaaatcatttttttgtgaagaattacctttcttggcataaaataattggaaagtacccggatatctcaataaaacacatcaaaagtaac

SEQ ID NO: 263648 - DNA, 397 bp, Homo sapiens
attacttcctatagtttcttttttacaaaatgcaaatgctctgacattttacctgtatgtttccccataaattaatttacttaaaatatgcttctagaaaaaggcagtattttaccaaaatgaggaataaaacaacatagtatatttatgaatatacttgtacatttccatcctctataatttaagagtcattaaaataagcaccgtaaatataagaaatgatattcaattgtttaataaaaaacacaaaggggtctcaatatatggtattgaacagctagtttgacaacaaggagattttttcagtatctgttcattgtgttttatggatattcctcttccactatttacttatattcataatatttatatattattttataagtaatattatatt

SEQ ID NO: 263649 - DNA, 623 bp, Homo sapiens
ggcagtctgggtagcctcaggaacctgtgtgctgtataccttcaattgttcaactatctcctcaaattcaagccaaccattatttctttttgctgtcactatgtgttttgaactatttccaggcttagcattttgttttagagtctagaagctgaagctgctgaaactgtcagaaatttgacttccttttgaataagggcattaaatattcctacactcctaatatcattctctataccaaaccaaattccctgggttctcaacccaaggttgggttctgtgctctcatcatgccctatgagtccagccacatagagatgatttgcaactttaatcttttttccttctaagctagtctctcttcatttttaattcaagaagctgcctttctcatagaaaaacatacgcttcattaaattttcaaatttcaagatgctcacatgatataattcaatccaaatagctagcacaactaaaccttataaaaataagtcatagcaatttaggggttttaaaaggtagaatgaggatgccaagtgtttgcacattattttaaaatatcttacaatattcttcttgaattaagaggtcctggccaattccctgtgactcaggtgatgtat

SEQ ID NO: 263650 - DNA, 424 bp, Homo sapiens
gccaatgtccaacctatgtgaggaacgacagaatagcagaatgaccagacatacagaaagaagggaaaagaacgtgtgcaacagaatcaaatggcatatcctcctgcccacattccccaagcctcagccccatccccgcaggaacaggcgactgtctgggaatcagccccctctccctgaagctgcttacctagtcaccaacttctgggaaccagacacttgcacgccattgttatttggggacccacttggttcaggtgcttctcagcaccatccaaagggattattttaaccaggcgtgttagagaggcagcaagaaggaacacttggacccaaacccacacagtggcttgagggctttatcatttttaccttaagcatctaaatatgtacagcccaaaataaaattcagcagtaacaacaa

SEQ ID NO: 263651 - DNA, 83 bp, Homo sapiens
gaataacaattgtattgatattatgttgtttagagtaagtggcaatgtattctttgaagagttaaaactgttttctgtgttta

SEQ ID NO: 263652 - DNA, 326 bp, Homo sapiens
gagaattgatgctgatggactcttggttgcctacctgtatcgtttcttctttgtttctaccagaaccttgattttgtttagatatctcctcctgtcccacatagtaatgcatttcaggggaagctgaccccaatcccacctctaggtgtgggcctgattggcagaaacatgacaatctcatccccttgctcatgtttagttcagtgataggcatggggcgcagctctggccagtgaaactagaggcaaagtttgctgggtgggggcagaagaggagttccaaagaccatttctgagagaggattataaagatatatttcccttatt

SEQ ID NO: 263653 - DNA, 440 bp, Homo sapiens
gccctgatctaggggcccctggcaagaggtggggtgagcctctgctctcacattgcctcacccctcaatagtgagtgctcagcgggcaggctgcaccccaccctctgggagaacaggattagtgggaagatgagacccacacacagctctgagagagtaaggcagctcaccagcactgagctacaagttgaggagccgccagggacctgcagatgcccggcaggaggaccgatccctcatggagtttacattccagcgaggagggggtgctgggagacatgcagagctgtgggcggggcttccttggaggaggggagaggtgttcgccactgaccaggggcctccttggttcttttagctggacagccaagggggcttgggccggggcaggtggccttcagatggacaggggccggctcaggagcccagcctggctcagg

SEQ ID NO: 263654 - DNA, 693 bp, Homo sapiens
aaacactcctgagtatcccctgcagtgcctggtgtgtgagctctggctaagggaatatggacaggagagttaaatgccacttccaagcctgacctccaaaacccttcccacagtctctcacatgttgtctcttccccattaaccagcagaggactctggtagtggagcttaactgtgctccactagcaggaccagagctaagattctgctaggtaaagaagagggaactgcaggcaccctggcccagaggcctgacacctgatgcagccaggagaataaaggtaaagagccccacaggagagaaaggattctgagtctctgaaaaactgcaaagagaagagcctcccagcccaacccacactcacacacacacatacacaagctgcactgggctgtgatatgaataaaagataatcacattgtgttaacccactgagatttgggggttgtttgttacagtggctaacgttacttactctagctaacatactcttaggttttattaacagatgggatgagataatgcatgcaaagtgcccagttctatgtctgatatacagtaggtccctagcatagcactctacctgaaacatggtaggtgctcagtaattaagggttataaaaagtcaaccagttgcttttcttagaggccctagagacagcatcgtagccaacatgagccttttgtagctg

SEQ ID NO: 263655 - DNA, 456 bp, Homo sapiens
ggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcaagcaaggataattcagatttaatctatgcaatctatgggggaagactgatcttccaagcaatttcagcaaccatgagtttctggccccatgccaagattacccatatgttatgacagataagtttgcttggatgttttaacaaaaggaggggattccagg

SEQ ID NO: 263656 - DNA, 793 bp, Homo sapiens
gacacaaagatgaaatattttgttccctcactgctcggtaactattctcctaagtccccggagtttctgagctgtgaaaacaaaacaaagcccatctcaggacagctgaggcccttttgccctcttggtttgccttgattttgttagtttcacctagaggacaggactagacactgtggtccaagttgggaagataaaatgttgtctgtttctgaagcaaaaaagctgaggctgagataacaattagcattgataaggtccctataggggcttgaaagagaaccctggcttgtttgtcagcttccgtgtgaggctgtgagcccactggtcatggttagcacttgagctatcccctgtttgtgggtaaaccagaactccaagaaaaaagcagctctgatttgtagcattcaccaatttccatggtgtaaatactcccactacagccaatttcaactggtaagtggtgatgtcacagaaggaggagctggaaagagaagaagatattcagctcttgctgttctgggaggaagtggccccagcacaccactgtttggaaccattttctcagggcttccttcccctgcttataactttcttcattacagggcccatactgttgcccatgagttcttctaaaatgtgggcatgatcgtggtgcttccagggttataaaccatcaatggctccctattgtctatgagataaaacctaaggttcttagcccagtattcaaggcctttttaatttggcctcactcttatttttttttttcagtcagatacatgacccatgt

SEQ ID NO: 263657 - DNA, 412 bp, Homo sapiens
tccaaataagctccaagaaatgtttttggtaatggaagcagaaaacaagcctgtagctcatgactactttggaggaagaacatttggatttgtaaatttagtgtgttaaaaaaatcacttatcacagatgtttggaatcttcccactgatttctgcatggctgcttatttttcttcccttaagtctcagttcatgtcacagagggcttccctgacctctcacacctcaccaccatcaacctgttttctccatagcacctatcacagtctgaattgtcttattatggccttacctatccctaacacccatttaaaaatgtaagcatgaaagaaggaacgttgtctatcttgttcattgctgaatccccagtgcctagaatagtaccaataaatacttgttaaatgagcaaatg

SEQ ID NO: 263658 - DNA, 480 bp, Homo sapiens
ttgatcatcctatgattctcagaataagatcttataatagtaagaatattgagagttatgaaacattgataaattatacctggatgggatgctgagagttgttctttacctccatttatttatgattataacaataagattaataataatgctaataatgttattgcacatactatatgtcaatgtaagtactaatgcaaaacattattacctccattttgctaaagagaaaaattaggtacagatagtttgtgtgacttgtctaatattgcatagcctttgggtggcatgattatgatgtaaacctagtcactgcggtcctagagtcagagttttcaaaattagtacagtatttccaaaccttgatcttttcatggtcctaagtatataatttttattctcatattcttaatatcttgctgtgttaaatggagacagtgtggggaattagctccttgagttgctattaatagattagtt

SEQ ID NO: 263659 - DNA, 482 bp, Homo sapiens
gaaggtgtaggggtgctgggctaatgctccctgagtttggagcaatccttagaatcagtcaatcaatggtcctgtgggaagatgcagaaaggccatgggtttaacataactggtcttgaatagtgaatccagggccatggagcccaggcggccactttccccaccctccgcccccaaccccccactgccaggttctgctctaaaatctggcaaaaagggggctttaggatctctctttacaacatggcaaaaagctggtgttttaggcaggtcacacgtattcaagcacccatgccaccagcttgtggtgggatacccagcagaaggattgtttacctcacccttggaaatatttgaagtgaaagaaatcaatgggctgtagttaatgtctcaagatcattgcttgtcatggaatgaaatttttcacctatgactatgagcgtatcagaataaaatgtgcttttatgtttaaataaggaata

SEQ ID NO: 263660 - DNA, 366 bp, Homo sapiens
tttttttaccttcttgtgggcgtgttaaatgaagccattagatgataagcttcgaaaggcagaccttggatgtcctccaacctgttttcctatcagacccagcacacagtaagcatatatggtcaggaaactacctctgtgttcctgggcaataggtaggtctgtgatgggaaaataaccaagccagaacaagcagaggtcagtcgatcaacaccaagttttcataacttctgtgtgcagagatctgtggggagacccagaggaagaagccagtaagtcttgcccttagagaccctctggtctagtggggataaccgaaccacacacattgggaaaaaaatagtgtggcaagtcttgctagaaaat

SEQ ID NO: 263661 - DNA, 451 bp, Homo sapiens
cacacaaaaaaagctgtgagtgtgcatgtgtgtgtgtgtggcagatttatttatttattactcaaaattggaagtaacccaaatgtccttcagctggtgaatggataaaaatatccatacattggagtactactccccaacataaaggaatgaattattaataaacagccacatggatgaaactcagatgcattatgctaagtgaaagatttcagaatcaaaagactgcataatatatgatatcatttatgtgatattctggaaaaatcaaaactataaggacagagaacagatttgtgttttctagggcataagcaaggaggagggagagttcaactacaaagagacactacaaaggaatttttggaagtgatagcaactcttctgtgtgtttattttggtggcgattatgtgactgaatgcatttgtcaaaactcatagaactctatac

SEQ ID NO: 263662 - DNA, 1251 bp, Homo sapiens
ggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctatcagaagtctacggagctgctgatccgcaagctgcccttccagcggctggtacgcgagatcgcgcaggagtttaagacggacctgcgcttccagagctcggccgtgatggcgctgcaggaggccagagaggcctacctggtggggctgttcgaagacacgaacctgtgcgccatccatgccaagcgcgtgaccatcatgcccaaggacatccagttggtcagccgcatccgcggggagcgggcctaagcgaaatccgctcctgctcccaagaagggctccaaaaaggctgttacgaaagtgcagaagaaggacggcgagaagcgcaagcgcagccgcaaggagagctactccgtttacgtgtaggaggtgctgaagcaggtccaccccgacaccggcatctcgtccaagaccatgggcatcatgaactccttcgtcaacgacatcttcgagcgcatcgcgggagaggcgtcccgcctggcgcactacaacaagcgctccaccatcacgtcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtctagtcttactgagttgcttgttatctgtgctacgagattagaaaggtttgactcgttctgggatatttgggagggatggagggaaggaggcggggggtggttctacaccccttcagcctttaacctgtatctttaaagtcgttttcctttttgtttctgaaagtaatgaacgagatgagatttcccatacagatgagaaaccctcggtccaacctcttactatttcttagtgttttaatctgttttccttaccatata

SEQ ID NO: 263663 - DNA, 363 bp, Homo sapiens
atcccgtctccagggaagcatcaccacagttccaacacggcgtcggaggccccgaggtcttgggtgctcagtgacgtgagccacatttcttggtgggaggcctgaaacacctccatctcctcctaggtcgctggactcagcctccgctccgcatgacctgggcccagcttcccaaatgcccctgaacgccagccatggctctggggccaggctggagaagattcctccccacccccagccccaaagcaaccccagagcatttggtaacaaagaggccagaccacaaagcgcaaacagtaggcaggccgttccagcctgccccggctggagcctgcaggcctgggcaagaaaccacgagaaaca

SEQ ID NO: 263664 - DNA, 354 bp, Homo sapiens
gtttctgtggtgggggtgaaaatgctagaggtgtgcaccaaaaagggtgaatctgcctctgcatgcaggtgacggcgtgatgtaaacagaaggcttttctctctagagccaactaatttccagaataatctgagccaggcgtgttggctcacgccggtaatcccagcactttgggaggccgaggtgggcggatcacgaggtcaggagatcgagaccctcctggctaacacagtgaaaccctgtctctactaaaaattcaaaaaacaaattagccgggcgtggtggcgggcgcttgtagccccagctactgtggaggctgaggcaggagaatggtgtgaacccgggaggcggagc

SEQ ID NO: 263665 - DNA, 315 bp, Homo sapiens
actaaggacaaggccaactgataactcagtaaataatcgagtccattttgtgcttgcgagttaggggcttaatttggggtggtttgcagattaagtactttcactgcatataataaacgtacaccagcaaaccactcatggaattcttaaaaaaacttctgagctagtttaccagtttcaaagactaattcagagagcatgttttacctattctaggctggactggaactcctggactcaagcgatctttccatttatcagggactactgacgcgtgtctcccaataaatacctgagtataaacaaaaagaggac

SEQ ID NO: 263666 - DNA, 415 bp, Homo sapiens
aatttttttatttttgtctgacacacagattaaagttttccagtatttcctacataacattaaagggggaaaggtaaagaccagatatgtaattacaaatttttttaaaaaaaatcactccccaaatagtacatgctttattttttaagattaatatactggaaaaatcaaactttacctcaaactcatggtggttccaggagatcacatttgcacttccaagttctctgtcaatattaaatgctctcatttcagattcaagagtatctttcagttcttctcgtgttttgaaattccaaataaggtttgacctggcatggtcttgaccaaacctagacatacatataatgaggaaatagcaggatgcactaagcattttaaaaaatctataaatatcccttactgaccttataat

SEQ ID NO: 263667 - DNA, 441 bp, Homo sapiens
cagtagacagagtcattcaccaagcatgcctgatcttataaagcatgtggcaatgagcacagtagatcatgtactgcatgctaggacctcattcctgagaaagcagaaccattcaatccaagcattcccaactttaccaaacaagaaagtcactctatcctccctggtgacaagagagtaagaggcaagagaaagcagaatgacagaaatagatgtccctccacaagtcagaaaatgtcagaagtaggaaagaagtggctctgatcccaatattttttaaaagtggagttttcaatttgaaaataaataaaatgcacttagaacatgaaaatttttcaacaaatattaagcattattaattggtatattatcatcagtgtcttttattctgtatttcttcttgtaataaaacatgtctttgacaatgcctaaaatagctaa

SEQ ID NO: 263668 - DNA, 443 bp, Homo sapiens
tacacttctagacaacacaaaccttaacacacaacaggcatgcattacaaatttaatgaaccacaaattcaaattcagctggtgtttactgagtgctaggcaggtatttgaatccctctgaggccaggtgatgttacaacgctcctaagtggcagagatgaagtctaaattctgactctgcactgccttttccactacatcacgatggccctatggaattcagtctattcaaggagggcagcagaagcggtaaacgtcatccacgctttgaatacctgggcaacaaggtaaccaaccacacatgtccctgaggtcatagccaggcggtaggttggcaagcagtgtctgtctgtttcacttagaggaaaggagtctgaagcaaaaccattttaatcctgtgcattttgtcatgtacaataaaatacagtaaaagcaaaaagaat

SEQ ID NO: 263669 - DNA, 621 bp, Homo sapiens
acttctcagctaacattcatgggaccggcacaatctagtttttcccaacctgctgtttccagctgtacctaaaaccactcaactctccacaaattcactgaggccctttcagcccagtcgcatgttggacaaaaaaaacagaagaaagacttagtacctggcaagacttaatacctggctctgaggtgctctcagttacaagacagaggagtaaataattaccagaagatgcagtcagtgataagataaacaaaggacactgcttgccctaatgtccccactccaaaataaatgatctattcactgtcccctgaatactggcctatgcttattttttcccgctaggattttatttggccttttttctcctcctttcctgtctaaacatttcccattgttaaatgctcaggccctagtgcccctcctttgagaattctgattccaaggcaagggatctttccctcctctggagttgaatgttccattgagaaacacctactcttccagcatgtctcagcttatctgctgtgtgtgtgtgtgtgtgtgtgtgtgtgtgtgtgtgtgtgcgcgcgcgcgcgcgcgcgcttttgagccggagtttagctcttatcacccaggatg

SEQ ID NO: 263670 - DNA, 242 bp, Homo sapiens
tttactaaattttaaacctcaagcacacatctgtttaatagtcagtgtaagaacataggcagcatttctggtgcatactgatggaaaggcagttgtcctgtggaaaagccattatgtaattgcatgagttgtgagtgaagttaaacattttttttttagtgggtcatcattttccttgaaagaatgactgaaaggcacactgtgattattcagacttgggtatttggtagaaattttctcaa

SEQ ID NO: 263671 - DNA, 443 bp, Homo sapiens
ggccccaacactggctaaaggagcatatgtccacagcattagttggtgttggtgacgcttcagaagtatatgcaagctccacaattttacattgcatgggccctgaaggacaaatgggaactatctgccccctcattacacccattcctgttaacctgtggggaaaagatcttttatatcaatgggggacatagatttcttttccacaaggcagttacagccagcaaagtaaagacattatgacaaaaatgggatttgttcaagatatgggcttgggaaaatcagcacaaggcatcaccgagcctattatacctacccataaaccagattctacaggacttggttattctttttagaagtggtcactatcaagtctccagatcccatccctttgacttggaaaactcagaaactggtttgggtagatcagtggctgctcccaa

SEQ ID NO: 263672 - DNA, 687 bp, Homo sapiens
atcagactgcatgtggcattttggaacctattttgttcatttagtgatgtctttccaagtcattagcaattgacttcaccactatttgcgatggcttcatgaaggttcataattaaatgtactataatttttttaaattttattttattttaagttccaggatacatgtgcaggatgtgcaagtttgttacataggtaaacatgtggtttgctgcacctatcaacccatcacctaggtattaagccctccatgcatagctatttatcctgatgctcttcctcccaccgccctccccaccctgacaggcccaagtgtgtgttgttcccctcgctgtggaatttgaccattttatatacctcatatgagtggaatcatgcagtatttatctttctgtgattggctaatttcacttagcacaatgtcttcaaggttcattcatgttgacacatatggcagaaattttcttcatttttaaggctgcatagtatttcactggacgtatacaccacatttatttaaatttaacttttaagttcaagggtacatgtgcagatttgttatataggtaaacttgtttcataggggtgtgttgtatagattattttgtcacccaggtagcaagcttactgcccattagttatttttctgatcctctccctcctcccaccctccatcctccaataggc

SEQ ID NO: 263673 - DNA, 276 bp, Homo sapiens
aaagttttgttaactgaaggatgcatcaaagttcctttattgccatcagaggcaaaaatgagtaggtggggatggatggttgcctggctggctagtttgatggactgctggcagaaattaatgtacctctcaaaaggattttaagcttctttccacatagacaggatataatggaagaaaaacggtgagaaccattatgccaaaatgtatttgatattcatattgctggggaatacttcactgagatcaatcagctatttagcagcaaaagaaatt

SEQ ID NO: 263674 - DNA, 204 bp, Homo sapiens
gcgggagtggttgtttagatattttcttcctcacgtgaaacctagactaatgagttatcatctaacaagctgtaggtagtttggctgggctggatccagatggtttgagttaaatctagattgtacttgcctaaaattctgtaaacctctagctacgcaaatcctatttccaaaaatgctgggaagtcactgtataagagttta

SEQ ID NO: 263675 - DNA, 242 bp, Homo sapiens
tttttcctgaggtgttccaaccctgggctcaagccacggagggtggacagactgcacggtctggacttgtaactaagtctcctctctgtaactttggtccttgcaagccaaaacaaatccataagccactgcttcagagtcccagagttgtaggaacaccaccttaggggaaaagagaaaacattgtggtcagtttcagatgaacctgcgaagaaatgttcctagagctgctttgcagtgct

SEQ ID NO: 263676 - DNA, 109 bp, Homo sapiens
tttaatttattatcaagtttcctggcaggaccacaaggttacagaaaccaaaatgaatcaatgagttagggtgaaagtgtagatttcataaagactacccacaattact

SEQ ID NO: 263677 - DNA, 981 bp, Homo sapiens
agccgacttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaagg

SEQ ID NO: 263678 - DNA, 720 bp, Homo sapiens
agccgacttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggtacctgctcttgaacgcactttgttgttccattttctgtcctttcagttaatcaagtttccgtcactcagtaagttactactgaaaaatgatgaaatatttgttgaataaatgtgagagtgggtaggaaaactacttggaaatgagtattaccaataacatcttaccactttgattttaaggcattcgtctgtggaccatagctattgatgaagtaggtcttgttattttgttatgaggaaattaggcagagtttatgttattaaatactttcccgaagttattcaactgatagtaagaggtggatttgggattgaacccaagcattccttttcagactgtgtgatcttttttgtttgtttttgtttctttggtttttgttgttgtttattttctattcctttttctgagtctgtggtcttaatctcaatgatacagtcgtcttcagttatcttaaatagtaatccatatggctaccggtgagtcgttggaaatcagccttgggaatgtag

SEQ ID NO: 263679 - DNA, 1394 bp, Homo sapiens
cggccgcggcggaggccgagaggccgagggcgggaagtttgctctcctcccgcacttggcaagcagcgccgctagttctgtgggtataataaacagcgagttacctatgatccgcgctcctgtttcctcatctttaaaatagcaataaagatagtcgttactgtgtagggttgtaattagaattaaacaagataatacgggtcaaaccttagaacagtggtggcacctgatactgggttggctcctgctattgatacagtgattccctcacaagcgccctttttactggaagctccagtgaagagagaagaaaagtcagggctttatgccatggcctttctgtcgtatccttcaggagaccgagctcttcccgaacttttacagatcttttttttttttaagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtgggtgaggacaggcactctctgaccctgaacttcagttcccttgagaatctctttgctctcagggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaagg

SEQ ID NO: 263680 - DNA, 254 bp, Homo sapiens
ttttttttttgtcagcaataaaacctgaatattttgaatttttctaccacacagcagttcaatggcttaaagttttactacaattgttttgagttcaggaccaagatttcaaatcttttgaacaagaaaatctaccctcaaccactactgtataacattgaatggatttataaattagtttttgcagtggtaacattgataatttgttgaaatgaatttaacataaaattaaagatgaaacagtgatgtctaaa

SEQ ID NO: 263681 - DNA, 469 bp, Homo sapiens
gtaaaaaatatgtcagactaatcttactagtagtttattgcctctatggtattgtttgattatattgtgttatattacatggtgtcacatagtttttcctgttaaaatatctgaaagtttcactgctagatattaaaaacttttgtattctctagtcacctaatgaaatacagatatctctgggagttgaaataattttaaccattatcaggtaattcttaaggagctcattgtaagaaacgtgataaaccacatgaaaattttgcatggtaagtaccaggagactactgtgcactacagtgtatcatggatatattttacaagaggagcacgtgattcagtcctgggaagatgccatctaggctgaatctcaaatgatgagtagatgttagctgggcagattgttctctaagcaaaaatcttaaaactcccaattcctctttgcccccaaaacctttcatttgttaaa

SEQ ID NO: 263682 - DNA, 702 bp, Homo sapiens
tgttaaaatggaaacatcatctcttcatacatatgcttgttctagagtttaagtgaacagttgtgtacaacaaatgttcttgtcttcctttagtattatttcaaatcatttgatatgtaagtacaatattaggtaataatttatatcattttggaaatgtgctatctttccaactagacttgaaaatattggtaaaatctttattaagggcctgcatgtttttggaactcaataaatgttacttctgtttcctgctttaaagattttatatcatgctaatgttaggaggccatagcaaaaatacacagaggacaaagcttaacacttattaaagataaagactatattttcatgctttgagaatgtcttaaaagtaatcatggaaaataggaattggaaacttctaatcctaaatgttgcctgtatcagactaaccaccctagttggataaaacttaaaatagtaatacaaaacagaaaaacaactgtttgaaagcactggagaacaaccaaagcagctaagatttgaggagccaagatcatactataattaacccgacattctccacatcttttccgttcaaggcagttgccagttcctaagctggctgtgtagctgagacgctaagcagaaaatagttcctaaaaggctaaaaaattaactacaaatccagtagtttgatagtgctaggagaaaaaagaa

SEQ ID NO: 263683 - DNA, 219 bp, Homo sapiens
ggcttctttctcttttcccagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggtgagcaca

SEQ ID NO: 263684 - DNA, 125 bp, Homo sapiens
tatgcacaaagagaatagtcagcctcattgtttttaaatcattattaccatcatcattattaaatcagagcaatttacttgattacgtgtatctcaaagctattttaagattaaagagtaaataa

SEQ ID NO: 263685 - DNA, 292 bp, Homo sapiens
cttcgtggaaaatttgaagacagagacaatgttttactattttcatttttgcacctacagtttctagcataggcttggcatcttgtaaatattcaataaatgtttgttgaatgagtgcgttaattgattctcctaccagtctgagctatcagttatgtctctgtggctagatggacaccatgtcttccatccctgccaagagttcaactgaattcaagtttataaatggaaatgtgtgtgtatgaaggaattaaaacaattcagaaaatataaagttttaaaaacgaccttt

SEQ ID NO: 263686 - DNA, 145 bp, Homo sapiens
ctcaaaaaaaaaaaacaaaaaaaaaaaaaacaaaaaacttatagcatcaggagaggtttaggggtggagcgggacttctggcctactgtagccaccctgcctcaagccacataagaccataaacagcctttatgcttcctattga

SEQ ID NO: 263687 - DNA, 287 bp, Homo sapiens
caaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttctt

SEQ ID NO: 263688 - DNA, 751 bp, Homo sapiens
gcagaattcatgattcagacctcaaaagtggaagcaagaggggctgagtacagtcactcatgcctgtaatcccagcacttgaggctgagggaggaggattgcttgaggctagaaatttgagactggcctgggcaacgcagcatgactccatccaaataagttgggtgtggtggtgcatgcctatagtcccagctatgcgggaggatcgcttgagcccaggagttcgaggctgcagtgagctctgattgtgccactgcactccaacttgggtgacagccagactggtgtcttaaacacaacaaaaacaaaatgggacttaagtaagctacgaagttcttgcacagcaaaagaaataacacagtgaacagacaacctgcagaatgggacaaaatgtgcaaactatgcatcaggcaggggactcatccagaatttacaaggaattcagcaaaccaaatcaccctatccaaaagtgagcagaaaacatgaataggtatttttcaaaagaagagataaaaatggccaagaagcgtatgaaataatactcaacatcactaattagagaaatgcaaattaaaaccaaatgagatatctctcatcagtcagaatggctattacaccccattcaatgtaagagaatagtaccttatcctgtaggctgcctgaatttattaggtaggcgcaaaagtaattgcagtttatgccatattaagcagagtatacaaaccaatttctaaggaagttcatcacagca

SEQ ID NO: 263689 - DNA, 431 bp, Homo sapiens
cacacacacacacacacggagagagagagagagagagagagagagaaataatcatataggtgctagaacatattctataacttacataaaacaagttgaattttcatttgagtttgaggagaaatattatggaccatgttcagtggtgacccagtaactctttctgaataataactctttctgctcccccactgggatttctgggagctttgcatttacctcacagtggtatgagccatgtggtcacatcctataaagtcatcactttctaaggtcaccagatgtatggagaaaaggccaagcaggcttcttactgaagtctttaaccccagagtcaacaacagtgcaccatcaatttagttagaaaacaagaatgacttagtgtcccatttctgagcaaagatttcttctgaattaagcctcgtttttat

SEQ ID NO: 263690 - DNA, 883 bp, Homo sapiens
cagtggctggcgcagtccccaacaggactgagaaatgttggcttaggctttcctagtctttggttgccgcttcaaggcactgactgggccctaccttcagatgaagcaccttctccatgactgctgcccttcacgtttgacctcttctaagaatccttccctaactctacctggcttcaatagcttctcttcgacattctcttgctactatgccaagagaagagaacagaaatgaaatctgataagtgtgtgcctcccacgaccatcccttatagacgcactctcgctctgctcgtagatgccgcggcccatctgtggggcctgcctgcccacgggccggaagtgttggactcaaaagcaatccatcaaatgcggagacacatttgcactgtgttctgaaatacatttttaacttttattgcattctcacagagcctaaaacaataaattcattaaagaacagcaagagtgtagattaagctcacttttctatttagcctgcaaaaagaggtgtgtttaaaattaacggcagtatttttttttgtaaagaccagagtcaggcttttcttcggtactgcttgctgattggccagtgggcagagttctacatgtgggcctaacatgcaccccaagggcttcagtcgtccccactggcatcgccatcagtctatgtgcgtccacagggcagtcgagcttgagcgtctgttgggcggtaagttctcagagcccagtctgtttggcaggttttttacaacatgcaaaccaagcttgccttccagaagcatctgagtcctgctctgaccacagggacttcttataggctttcttagagcatcatgtatatccctctgcaaagccaccttatttctatgacaccctgaaa

SEQ ID NO: 263691 - DNA, 432 bp, Homo sapiens
agagggaactcgcaggagcaactctggaaattagttgaaaacagcaggattctagcctgggagcacttctagaactctgccaagttggccgtggccactacctttgttggaaacaaagcataagggagtgaaagtgtctaaagaaaggtgggggctgggtgcagtgacccacgcctgtaatcccagcattttgggaggccgaggcaggcagatcacgaggtcaggagattgagaccagcctgaccaatatggtgaaatcttgtctctactaaaaatacaaaaattagccgggcatggtggtgcatgcctgtaatcccagctactcaggaggctgaggcaagagaatcgcttgaacccaggaggcggaggttgcagtgagctgagatcatgccattgcactccagcctgggtgacagaatgagactccatctc

SEQ ID NO: 263692 - DNA, 372 bp, Homo sapiens
tgctgagtgtgcttctacaagttagatttcaacatatatatgttgatttggtcgattatacaaatcacatttcatacaaaatgagttgtatcaacaaccactgctttttaagaagtgcttttaatgtaaatctgaatacttttactgaccaaaccattataaagtcttctctgtggtttaggctggaggacagtggctggtaaagtacagttcagagtagactaggaacagaacaaactttggagatttgacaatggaaatgagattttgggggctctgactggtactacctttaaaggttttatactgagagtattattggcagcggcaaaactcctgctctatacaacgtggttagtgttgttcccttat

SEQ ID NO: 263693 - DNA, 491 bp, Homo sapiens
gattttacctgttttgttcactactttacctgcaatggccagaacagagcttagcacacagtagaagctctattaatgaatgaagctggagtatagtgtgtgggaagagactggtgggaaatgatgctaggaagctgggcagattgtgaagagtcttaaaggaacttagactttatgtcatagaagaaagcgaaccactgaaggcttctgagtaggcaacactgggcaacgctctctgctgtatctgaataggcagagaatgtgtccctgagtgggctcaggactggcaacctttctctatataggcaccagaagaagttctctggacagcaggacagagccaacactgcagccaaagaatgacattcctatttcttgttcttctatatatggtacagcagaaaatcatatggtaaaatcaaaagaaaattatattctgaatcaaacatatctaaagtttactataatcagtgggcagcttggtccccaag

SEQ ID NO: 263694 - DNA, 805 bp, Homo sapiens
taaatcttgagggtatcaaaggattgaaatggaagagccctgaaaattggacattaaaaaggcattaatttcaagagcattttctctgtcctgtaatttcccctccagtatgagattgtggtgggaagatgcacctctccacttcaccaggtgtgagatgaattttgtttcagtttgatgtcactcagaaatagatcccgagacaaggtttcaagttctcagggtttatgtggaagataatccagaaagcactagtggagaagtgggaaagtgatacaggaaagagaaccaacaaaggatgtgttaccccactgatgtcaactggagtaggatcccactaggatacgcatggtcctgggttctcatcttgggcagaacaaagatctacctattctggatgtttcatataaatagaaccataaatattgtgacatttggtgtctgggttctgtatcttagcataaaaatatattttaaggcaaacaaaaaattgttactactcaacaagacaaataacacaattaaaaagtgggcaaaagacttgaacagatgtttctccaaacaaaatggccaatgagcacagaataacgttcaatatctttagtccttagggaaatgcaaatcaagaccagtgattattggaataaagtgaatcattgtgcttaaaggtttgatttacaggccgggtgcagtggctcacgcctgtaattccagcactttgggggccgaggcagagggatcacgaagtcaggagatcgagaccatcctggctaacatggtgaaaccccgtctctactaaaaatac

SEQ ID NO: 263695 - DNA, 897 bp, Homo sapiens
tgtcacttcagaagtggtcagtggatgttggcattattctcttgaggtggtcaccctgggttttaagtgctaggcattgagccagtggcaccccttagagtggggattggtattctatgaccacagatgtgttaggcaagactttcctggaattagtgataaaaccaaactcaaatggcttaagggagaggggatttattggctcacataaccaaaaactccagggataactgcccagagggaaatgagggaaaaaaaggaaatactcccttcctgggatctcccacttcccagtttgccaaggaaaactgagccccaggaggacactgaggcaaagtctcaatactttctccccctcctctctgaaaagagaataaaatgaaggcttggcacacacaccatcttcgagacagtgctagctcctgcctcctaggaactgattccaaggtgaactgctggtggtggaagaagcccttcaatatagcatgtattgattgcacttgatgtacaaaagaggacatagatgctgagggacataaagatgaacagagaccttgtctccagagttcacaatccaacggaggagggagacttgacatcagtattctagtaggaaggcaacctgtgaaccaggcacatttagtttcaacctcagctctgccatttactcttaaaatttccaaacctctgtgtcttcacctgaaaaacaggcttaataatatttgcgtatataggtgattgtgaagactagaaatggggtataaaaagcgctttgactgggtgtagtggctcatgcctgaaatcccagcactttggaaggtccagatgtgaggatcacttgaggccagcagttcaaggccagcctgggcaacatatgcagacctctgtctctaccga

SEQ ID NO: 263696 - DNA, 403 bp, Homo sapiens
atgcccctatttgtttggccacccatttagacacttctggcagcaaaatttggaaactacttcagggcccatgttctggtgatatcttagtggcttgaggttggggaagggctgagtggaccagattctaatggctgtaggagtccaggggaatctacttgcataaacctccagggatttccctagtaacttccttttttttttttttttttcatataagccccaagggctagtttccctctttactgttaggacctactgctttgcctcttcccatcactgaaggtttttaaagttttttactgctggcttttatagagaaacagacacagtagagcgaaaggacagtaaaaatcagattatctgtatcagttaatcaatttcctgagctttcttaatgctt

SEQ ID NO: 263697 - DNA, 532 bp, Homo sapiens
cactctgagaattgccccattgggtgggcatgtgaagcccagctctgttccatccaggtgcctcgggcctgaggagtctgaggatctgacttgggtcttggaagggttccaaccccaagtcagtcaggaagctgcccatttttttgcaaggcattttaatgccctttcccagacctctctagtccctcctgccttctgttctctgtagctgtgagccctttgtgagaatatgactcttaattttgaatcttatgtaagaggcttgagatgtgctggagagggcaggaagaggaaagtatcaggccttgagagagggaatgtagctttgcttctatgatctggagtcaccttcacttgctagctgagtcctaacacaacttccaagtccatgattctcttggggcattggatgggctcagtgtgggtctcttaggctgttcttgtgacttcatcatttcctggttcaaagttgtactgtcaaggggcagcatttctggtatttctataataaatttttctgtgatctcaaaaa

SEQ ID NO: 263698 - DNA, 516 bp, Homo sapiens
cacttgcgggctttaccgggtggctagcttcccccccaattttctccacaatccatgctaattggattcccatccacaccactgctctgaaatgtcactcataaatgtttccagttgtctaccccttgctagagccaatggtcagttactggccatcagctttcttggcctgttagcactatttcactttcatgaccttgcatcttgaaaccctttcttctccagacatttcttcccaccctcgctagatttccttctatttaactggacattttctctctatttgtttgttggttctttgactggccctctgaaagttggtgtccttcagcatcttggttgctaaggatatgggtagaattttaacacacagagataaacatgaggaggactgggaaaagaagaaaaggtaaacatgctgtaaatcttacagagaagttctgtttggctggagaggaggtgaagaggagattcatttatgggagaagtttgaaacatcccatcaaatatataaga

SEQ ID NO: 263699 - DNA, 304 bp, Homo sapiens
cagggacatggtgcatcttctctcttattaaggaaagttttactgtcaggtctcagaggctgaaagagaacctgagaaagctcttaacacctcaccggaagcacctttaacatccatatttttggggttttgtttttgtgtgtatgtgtttgttttggttttagttttggttttggttttggttttggttttggttttaggacggagtttcactcttgtcacccaagcagtgagctgagattgcaccactgcactccagcctgggcaacagagcaagactctgtgactcaaaacacacacaaac

SEQ ID NO: 263700 - DNA, 437 bp, Homo sapiens
ttttttttttcactaaaaacaatctacacaaataatttatctcatggcagaaaaactacctgttttcagaacaaaaaaagagaagacagtaagagcacctagaatcccaccatctagtcaccactagttaatatttggtggatattctcctctatccttctatagtttttttatatatacttattttttccaaaaacgggagccacactctatatatggttttgtagcctttttgtttgtttgagacagagtttcgcttttgttgcccaggctggagtgcagtggcgcgatctcggctcactgcaacctctgcctcccggggttcaagtgattctcctgcttcagcctcccaagtagctgagattacaggtgcctgccaccacacctggctaatttttgtatttttttaatagagatggggtgtttcataattttgg

SEQ ID NO: 263701 - DNA, 443 bp, Homo sapiens
agaatggcgtgaacctgggaggcggagcttgcagtgagccgagatcgcgacactgcactccagcctgggcaaaagagcgagactccgtctcaaaacaaaacaaaacaaaacaaaacaaaacaaaaatccttgctaccactggccctaaagcaggaggcatagggctgcgtgtgaggagtagtccattgcatgggcttcctccagtttggctttggatttttgagctctctgaatttgttgtttgtgtcctttgcacagtgtccctcccaggttgcacccgtgcctgcccctcagggtcccccactcccagtgaatttcacaccatgcagcatgtactttaagccatacatcttacgtatgttccagacatttggtaaaacgccgtttatgtgtttttcagtgactcacaaacattttatttacgtagatgaggaatgtactca

SEQ ID NO: 263702 - DNA, 665 bp, Homo sapiens
tgtccccgcaaagctgtctcttttggggaaaatctacattctgtagagaatcccacccttttccaggtctttttcctgatccaggagagaataaactaagagtttggcacctttttaagcctgataggaaacatttgcaatctcttctctctgaagcctcctacctggaagcctcatctgcatagtaagaaccccctggtctccacaaccccttattttaacccagacactcccttctgttgattctgggtctttagataaaccaattgccaatcagaaaattcttgaatccacctattatgtctccctaaaacatataaaacccagctgtagcccgacatccttgggcacgtgttctcagcatctcctggggccatgtcacaggccatgatgactcattttgctccgaataaatatcttcaaatattttacacagtttgactcttttcatcaacaataagatgcttcactatgttttatgttaccagaaattcagaaatataaatgcaaaataaatgttaacacttagtgtatacttaaattcttcagcttttgtgaaaataagagtattgtacaaatattcttcagcttttgtgaaaatagcattgtagatacaaatgaatactttttaaacttagtaattggaattaaaatactatgaaaat

SEQ ID NO: 263703 - DNA, 471 bp, Homo sapiens
ttttttttttgctacttttatgactaatgctgccttagaggccactattaccttgttgttcaggttattctgtaatcctcatagcaatatcttataaaacaagagacctatgataggttaggttttcactctatatattgaactcctcattgatatgtggacagaaatcaacaagtagaggaccaagcaaactaattaagtttacccaccatctccagtgggatgggtcagatggaaggatctgtttccttgattcctgtcacatgtacctgttgatctaattggattccttggcactacctgcttataaaattagtattgaaagtgttgtttcctttctctccagatgctgcctttatgcctgcatcagttttccctagcattccccatacttccaaattaggaagtctctgcttctaacaaaatatcgttgttattgctgatatggacacaaatcagcaagtactggat

SEQ ID NO: 263704 - DNA, 353 bp, Homo sapiens
cgactgaaaagaggatccctgcctttgagcagaaccttgtctgaccgaatgaaaactcccccggccattctttgctataaaagccggtcatttgccacgggttggagaggccattcccccacccccactccgtctccactgttgggtttgaaataagcataaacctcatttataaaagaacccacgtcacacacaccctccccgaaatcacagggcctggttggtgaagttgactgtgtctgttcctctctctccttccatttttgtaagcaaaaatgttttccaccccgcattggtgatgctgcaggcttctttaacaaaataaagtggtcacagcaacaaggaaaagccct

SEQ ID NO: 263705 - DNA, 411 bp, Homo sapiens
ctcacgcgctctgtgcaacagtgctgggttgcaggtagggagttcgggattatctgtgctcaacaggtaagaaaccaaaactcagagaggtttagtgacttctccagtgggcacaacatccaacctgggtaccaaaccctggtgtctgactgggagcacagtgtggtttcccttaagcccacattcctgtggggcaagaaaacaaccagcgcaaatgatgtgggccagttctgtctgctcaccagagtccccagcacccggcctggggctcagcacatccaggatgcatgctgtaagaacctgcaggataaatggaagcaggtcgctgcttcacagagcctttgttgtgttgatggcccagggaacagctctgttgtcctactgcaagaacaatggggtaacttttttgtt

SEQ ID NO: 263706 - DNA, 557 bp, Homo sapiens
ttccaaaagccaaaaatagaggtggcagaataagagagtgacatccccatcagcttgagtgactatgtagagcaaactccctgatgtctcatattgaatggacagcattatcaagtctgaaaggaaaataaaatttcactatgaaaatcactatgccaaaagggaaaaattcagctgaaatctaagtcatgcaagaaactgctcttccttttgtccctaagcacacggctgcagataaaaggccagatatctccacaggtagctactctatgttcaccttatcttatgtaaagtgctgatttactgagcaccagacaaatacataattggcttttcccctacctgctccttttctcgtgcaacacgtggattcagtaatgtgaccacaccttctctctttcccctccaaactgcgtttcccctttaaatactgaagcctttttctctttggagaaaggcacacaggacagactgtttctgtgatttctgtgttcctttcttcaggggatgtccttaatgttgacaaaataaacttctaaattgattgagaattgtct

SEQ ID NO: 263707 - DNA, 418 bp, Homo sapiens
gaactgcattctcccccaccccaaatatgtccaaatcctaacccccagaatttgtgaatgtgagcttatttgagaaaagtctttgcacatgtaattccagatcgcaagacaggattagcctggatttagggtgggccctaaatccctaattacctgcctgtaatcccagcactttgggaggccaaagcagccagatcacctaaggctaggagttcgagaccagcctggccaacatggcaaaaccccgtctctactaaaaatacaaaaattagttgggcatggtggtaggcgcctgtaatcccagctactcgggaggctgaggcaggagaatcacttgaacccaggaggcggaggttgcagtgagccaagatcgttgccactgcactccagtctgggcgacagagcaagactcggtgtc

SEQ ID NO: 263708 - DNA, 407 bp, Homo sapiens
cactgcctgaagatcctctgtgtggtggacacacaggtgtcgttcccgtgtgagtgtgtgcacataggtgtgtgtgcatgtatgtcgtgtgcacacaggtggggtgcgctgtgtgtgtgcacatattgcgtgcatgtgagtgtacatacatgtgtggtggtgtgtgcacggtttgcgcatgtgctgtgtgcatgtgtgaacatgtgatgcacgtgtgtgatgtgtgcgcacaggtgacagcacatgtgtccacgtgtgtgagcatctgtgtggtgttggtgagcaccttggaccttcgcaggggtccaagaggtgagctgtgtggaccttcgcaggggtccaaggggtgagctgtgtggaccttcgcaggggtcctccttgtgctgggtggctgcctgtctgttcag

SEQ ID NO: 263709 - DNA, 327 bp, Homo sapiens
ggctgcagtgcaatggcgcgatcttggctccccgcaacctcagcctcctgggttcaagcaattctccagcctcagcctcccgagtagctgggattacaggcatgtgccaccacgccctgctaattttgtattttttagtagagacgggggtttcaccatgttggccgggctggtctcgaactcctgacctcgtgatccacctgcctcagcctcccaaagtgctgggattacaggcgtgagccaccgggctcagtcgcagcttatctatatttaccataaacaatggccaggcaaggcagccattgactgacacattaatgtaagaca

SEQ ID NO: 263710 - DNA, 493 bp, Homo sapiens
cttgccgtccttcctgtggccttcactatttctcatctgtacttaacttctctgaactgacactgctactgctcccttcaccgtagtatagtacaaagcttagtgacactgagataatctgaagaaataatttctatagtctaaattaaaatcatgaacactttaatgattaagatattagaacatgtttacaaattatatgattacatactcactttatattaatataacgttcatttaaatgtgtgctcatatctttatataaaaacttctgcttgactatcaagtttatctgatacaatttaacaacatctgtagttatcaagagagcaactggttaataaactaagtattctatgagcaaatatagttggaatgttctaaagtcaaaatgaccgaaaaaattatcaagtattttcccttttaaacacagaccaatcttccacaaattgaaaattctaagaagttttgatctacttaatgagatcatcat

SEQ ID NO: 263711 - DNA, 365 bp, Homo sapiens
ataaagccagccacggacaagcgtggccatggggaacggcttcgcggaggggcagggggagtccagaaagaaaggttttgtcatcaaaacccatcttggtgacttatggatttggcatttggctcgatactttgttttgtttcctggcagcaggggggtctctttttcccttcacttacctattatcagtctcattaataacagaggtataggatcaggacataaatatataccaatgagaattacaattaccacaattaaactgagcatttattaagtgctcatgttgagcctcaccctattcggagcacgttacaagaactaacgtatttatttttgaacaatttgagacattcttgcctttc

SEQ ID NO: 263712 - DNA, 362 bp, Homo sapiens
ctcagtttcctcacgtggaaaggtgcagctataacaccgaccttacaaatgtaagaataaatgagagaaataatttgcccaaggatgtgcactaggaggcggcaaagccaagattccaaccagcatctgcatccacagccaagctctgcattacgctgatctccaagctgagccttcatattcatctcaggagttgcttttgaatgtcttcagcagccaaaagcaaccaaacacaataatttgttttacaaaatggggattattccaacttggagttgggaacattaaagaaatgaccatgaatatcagcaaataacggaagaactaaaataaatctcccttttacttttaaatggacaatg

SEQ ID NO: 263713 - DNA, 589 bp, Homo sapiens
aggccgtgtttgagttctggctcatcttttttgctaatttgctcttatgcatatcacccaacctcgctaagccagtttcatcatcagcgagaacagcacactgacatgcagggccagctcaggcgctaccacgagctacacatccgtccattcgtttaatcttcacagcagccctggaggtcacccaggcatggaatgcacagctctgccagacagaaagcgctttggatgcctgagaaacaacagcttgtccgggctactgatgcgaagagaggccatggtttcctttttctctgctctgaatggcagccttgacgtcacaacagctaggaaccactggagggacaaataacaaggcgcaagccagaagcgccctgctctgtcgcaggggcagggccattttcatccagttctgatgtcttctgtggccgctgcgagtcggcgggagtagagacaaatgactggagctttaggcgtaaaggcggtctctctctaggctgatcaaacagccctttgcccagtgctaattgccttcacggaacctggataaactacagttcccgaattaaacttgtttctgatgaactag

SEQ ID NO: 263714 - DNA, 269 bp, Homo sapiens
taggatcttgctatttttcccaggctggtcttgaactcctgggctcaagtgatcctcccgccttagcctcccaaagcactgggattacaggcataagccaccatgcctggcttgtgtcaagtactttaagtgagcatcttgacagtgctgcaagtctgcagacaccaacctgccttagaagcgaggaaacagtatgaggagatcaactaacttgtctacgatctgagagtcggcaagtggtagcaacgggaccttagcctctgtgattc

SEQ ID NO: 263715 - DNA, 625 bp, Homo sapiens
ggtgaggtgggaaagggcttggtgtcgtggggttgtctaccctggcaaggagtttattctttgtgctgtataggcaggaggaatgtggcaccatttctaggagaagtgtgacatggtccagtgtgtttctgaaagttagttctgatggcacagtgaacagagggactagaatgaatgggtgggagacaattgtaacagtccaggctagagacaaaggtggtgctgggtttcttatgtgtggatgtgttgctgttggccaagaagaatgagaaggagcgaatttgggcagtgggacctccaggcagccttacagttttcagttggggagtgagatgagacctggaatttatgggtctgtgtagttaaaaccatgcggtgtacaagattgcccagattgagtatgtggaaggtgtgatggggaggagagagagtgttaggaagtgctggggtcctgccatctgagaacaggagcccagaggcagcatatgcagccagaaaggagagaacccatgctgagggtcgtggataccgcctatccccagaaacagaaagccagtctacaatgtccagatcccccgggagctcagcagttgaggcttcccaggggctgcccttggctttagct

SEQ ID NO: 263716 - DNA, 439 bp, Homo sapiens
cctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctca

SEQ ID NO: 263717 - DNA, 422 bp, Homo sapiens
ttctgccttctctgtcctatagacatggttttaatgagttatcctaattaggtcaggcccacctgagataatctctcctgattaacttgaagtcaactgattagggacctttattacattgacagaatacctccacttttgccatataaggtcttttagcacaggcgctgcccttggagttcccagtgtatcagcaacagcctggagatcacgttctcatcaaagggtagaaagaagggaaactcaagccaccctgggaagaaccctaccttgtgctgctaaccactgagactgctgttggcacagtggaaaggggatggacacatcacaccaagtcaagcaagcacaattatcatcagaatcatgggccattattcctggatcaagtcctatcaaattaaagctaaaaaaagattagtcta

SEQ ID NO: 263718 - DNA, 217 bp, Homo sapiens
cgctctcctgcctcttgtgatcctctccctgtgcagtcaccttggactggtcaccccaagccacaatgcattctggctgtttagataccgattggggatcccctgcaggctgctccttcagagcaggttgctctagactggtggctggccttgctctaaacttccaccattcctttctgggggcagtttgatggggaatgctatcgatgcccctttc

SEQ ID NO: 263719 - DNA, 268 bp, Homo sapiens
gtgatgtctaaggggaggcaggatgggtagttgtttgatgggaacagagcctcagttggggatggtggtgacagctgtacaacaatgtgaaatgtacttaacgccactgaactatatccttaaaaccggttcagatggtaaatgttatgatatgtgtattttgccacaattataaaacaatgaagaggagcagcaggcaggcgggccagcaggaagagaacaggggccttggtcttggccttcaccttgcatgtggtctgaggctcta

SEQ ID NO: 263720 - DNA, 391 bp, Homo sapiens
gtccccagcgatttccctggggatacatcacccagactagagagagaggaggcatttgaaatgtcagggtggcgtcagaacagagatatccaataggcatgagagggtgcacagggtgtcttagctgaaaacaaagggcttgggaatcctccctggaaggacggtcagcagagacagggaagtgggtgaggtcacccaggaggagcgtgtcgagaagagaagcacgtctagaacgaacccaggggaaagtcgtcattcacggctcggtagagatcatgccatgccttctctctctgatacagcagtgttttgtagactctagaaacgtttgttaaactgtaatagatgaaatgaaatgtattaatagagccaaactgttttgttttttttc

SEQ ID NO: 263721 - DNA, 184 bp, Homo sapiens
tggtgactctgtacaaacactacacatactccttgtcctagattctttccccttatctgcctatcccaaccctgctactccctcgaggcccagttcaaggccacctcctccatgcagcccaccctgactactccttcccacacaatcaccttgcagaattcctcaagcgtggctgtggcattct

SEQ ID NO: 263722 - DNA, 197 bp, Homo sapiens
tttcagacaaaaagtgaagtcctttagaagtaggaagactttttaagggtcacagtcagagggcctcatgtggaactgctgacttggggtgaatgagattggctcctctgaagatgatccaagagataccaccaccttagaggagtatttggtgcttgtgtctggtgcgtgtagttacctagttaccagaaaataat

SEQ ID NO: 263723 - DNA, 226 bp, Homo sapiens
aataataaaaatttaaaaactccacaagtgtagggtattgtggattgctagcatatccatttagattatgtgcagttttaattattgctttatgtgaagactgtataaaacagttttccattgagaggaatcgtttaaaatttgccatgtcatatgttatttatgcaggttctagtttaaatctaaaaaaatcctacacatacacagataagagaaattataagaa

SEQ ID NO: 263724 - DNA, 152 bp, Homo sapiens
tgtagattctctggaattttctgcatagacaattatgttgtccacagatcgaaaccatttattcctttctaatctgtacgccttttcttttctttttttctctttttattgtttgctcctccttcccttcatgtgtcactttccacctctgt

SEQ ID NO: 263725 - DNA, 444 bp, Homo sapiens
tggttgttccagcctatgtgtaagggtactggctttctcagcctttaatatttaacctaaccatttagtcagtgctgaaacatttgtttcggaggcctgccttttcagcttttgtgagatctggcctgccagaagttcattaaccctccaggccattctccacactcctgctagatgatgcttcaagacacaggtaagactacatgacccctctgtctaactagaaaactttggccccaagccatgggcactcactggctaaatacaggcagacttcttagaggttaagagtgtgagttctgtgagcataatgacagagcaggagatatcagccttctttgccccagacacgaaaaaacaatgagacagctatttgtgaatgaaaatagccccaggagggctcaacagtccaattaagaagctacagcaacacagtagagcaaa

SEQ ID NO: 263726 - DNA, 966 bp, Homo sapiens
actgtcttaaaagactatgattaaaatgggcatcagtgtaggcgacatgtagggcgcaagagaatagccagatgtgaaggttgaaaggctatgtgggctagttgtcatggtattcctggtgcctctccccgtttgggaagaataacacattgaccaccggctcagaggaggtggcattataggtccaggccccttcaggagggcactggagtcaatgaaagcttttgctctcacccaggctcttggtttctcacgggcaggggtagcccaggaaacaaaggctgtatagactttaagtcgtgagaaaaacgacattcttatggtgaggctcttagagactgtctccatttaagcagcagcagtaaaacatcttaccctaaaatgaagaagcaaatccatttttattggctttcatagcctctctctttcaatgacaaagaaaccattaaaatgaatgtttaaagttcttagaagagctttctctaaatatttactctgtcagtggaaaaataaacattttttacatcgggtctattgagtttgttatatacagtaaaattcaccctttttagatatatagttttatgagttttaacaaaaatacatagttgtgtaaccaccaccatcacaatcaagatatagaatatttcaacatcccaaagttcccgtttcccttttcagtcaatcccttccccactacccctagcccctggcaaccattatctgttctctcttcccatagtttcaccttttccaatttgtcgtgtagagttacacagcacatagccatttgagtctggcttctttccacataatgtccttgagatccatcggtgggtacaccagtagttccattttttttctgagtagtagtccattgtatggatgtactgcggtttattcaccaacatatgggttctttcctgtttggggagattacaaataaagctactataaaaactcgtg

SEQ ID NO: 263727 - DNA, 560 bp, Homo sapiens
caatactttataccataccaattatttcttctttgagaccttgacacagtaaggtttatattctaagtgtgtttttagcaattatatatcaaatctaaaccaattagtttaatacaggagacttgttaaatcacatatttatgtttttctctctatgatgctaccagtttgtcagctgaacagttctgggtgcagcttgtccgatgacggatagcacagcacctcaatctgagtgctcagcagagtgcttgtgaaggcagcaccacagcaacagttgctcagagggaacggattcaggagccttgatttagcaatagagtccagggttttcagctcagtgtctttagcctgtctctgctggtcatgtcagttatgtactattcaatccaggaggtgctgtttacattgtagtacatacatagtcattgcctaatgagtcatacagagagaaaagtaagttataaattatgtcccccatttgctgcaactctcagtggtaagaatgattcagtgcagctataggagagtacttccattggcatgccacctgcctaaaatac

SEQ ID NO: 263728 - DNA, 665 bp, Homo sapiens
ttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaa

SEQ ID NO: 263729 - DNA, 404 bp, Homo sapiens
caaaaaaggtgtttaaaagcatcaatttattatgtttaccctaacttttgcattacaaatggactccctgaaccccaaccatgctaaatttaactttcatagtagttgccagttttacttatggatgtcttccggcctccctgatcaaactatataaatctttttcttttctttatgttgcttgactcactagaaacaggaacagtaagccatacttgcatttgatctttgtctttttttgctaaatagttggtaaaaagtagagaggattttcccttaataacttgaagactttaggacagagacgttccatcttttggctcccctaggccacactggaagaagaagaattgtcttgggacacacataaaatacactaacactagtggtagttgatgagctta

SEQ ID NO: 263730 - DNA, 461 bp, Homo sapiens
ctttggaaatccagggctttttaccctttggatcccagcttcagagagctgggctattttccatcaacttctctttgcttcaactctttagtagcaatctcttgtcttagagcccggtgttggctgacaccagagggggccccagcccagacgcacctggggttcaggctcctgactcgggacatctctcctccctcctcccaccccagccatgccaagactcacactcaccgtgcacctgtctggcttcaaaatctctctgatcctcccagcctcgttgagtcctctcaggtgaaagtcatgagccgatctgtctcttgtcagcatcacagtgtagccagccagaaaaagaaataggactttggggtcattttcccactttttgtagaaagtaaacagctcagagaactgaaagctatgggagaggtagagatttagtcaaaaagaagaagaaaaaaaaa

SEQ ID NO: 263731 - DNA, 293 bp, Homo sapiens
gaggccatggtggtggtggtggtggtggcaggtgtgttcccgtctccacccctcagggaagaagcaagttccaggagcctggacttttgccctgcgcactctctgtgtcagatggggagacagccatgaggacagacacttgaagtaccctataactggcaccatgcaagagagacaggcaggaggagactgtgggagctcagaggagacacttgtgctggcctggatcagggagaaaggaggggtgtcgggaggcttcctggaagaagtggcttctggattaattattgaag

SEQ ID NO: 263732 - DNA, 365 bp, Homo sapiens
agtttcctcaacctgtacctgtaacctcgtggagacttagctataaccaaggtagtcagggaaatatttgagcctggattatagattgtggcaccagccagagtggtcccttacagtattacagcctcacaggaacctgccattcctcttcttgggacctctctggtattatatgcatctcgtacctttcctctcccgctctggattttagtttctaggtcgccattaataaagcctgccttcttcagatttcttctgtctctgattctgagtcccaccctctctgactttattcattgcatgtcattgaaattttactggaatcatcttgactctgaccttctctagccaacaatacactcaaa

SEQ ID NO: 263733 - DNA, 246 bp, Homo sapiens
ctttttttttccaaattaaaaataccaggtaagaattataaagcagtaattcaaaagaactaggtaagagcctaagtttacttcagaacatatttctgaatcctgatgacaccttttattgtattttaaatgggcaagagaattagagaacttgagagaaaatacaataagaaaccaatatagagttgacttatttcaatagttcccaaagttaagaacttcggatttgtagcttgattcttcaac

SEQ ID NO: 263734 - DNA, 403 bp, Homo sapiens
tttttttttttgagacaaagtcttgctctttttcccaggctggagtgcagtggccacaatcttggctcactgcaacctctgcctcctgagttcaagcagttctcctgcctcagcctcctgagtagctgggattacagacatgtaccaccatgccaagttaatttttgtattttttgtagagactaggttttaccatgttggccaggctggtcctgaactcctgacttaaagtgatccatctgccttggcttcccaaagtgctggggttacaggcatgagctatcgcgcctggcctgagaaatctcattcttactcctactcccttgcacactatctccattctgtaggtagccatttctattaatttcttgtttacccttctgtcgtcttctctcattctttt

SEQ ID NO: 263735 - DNA, 1081 bp, Homo sapiens
ggagaaaagggatatatcaagggtaaatattattgccataatttgttccctttgcactcaagcaagatgaaaaaccagaaaccatgaacagcttagcaaattttaactatataaaaaaactaaaacttaatatggcaagaagcatcataaagggtaatgcataaaaagcaattggaaagcatgactgaagtaaaaactcctttacaatagcaccagaaacatgaaggacctggaaatagatttaaataaaatgaaaatcaattggaagggagtatgaaaatgctactgagggacatgaaaggaaactgaaaataagtggaaaggcatacaacacatgtagaggaagactcaggatgaaaaatgcattaattctgcctaagttaacctatcagtttctgtgtaagtccagtaaataaatcaacatatttttgagccagacaaatgacattgaagtttatgtgtaaaattaataaggaagaataattggaaagactatgataaataataataatgagggtgactagcactaccaactagtaaatcatgttgctcaccaaaagaattagaatggttttctattagtacatgaacagatagataaatattataggtaattgttaatctattaaagtataagaaaatatcaattttaaaataatatttacatgggaaaagtctttataactatgatataatacccaggagccataaaacaggaggtcaacaatctgactacataaaaatcaaatatttatttctgcatggcaaaaacaaaacaagaataacaccgtgaaataaccaaaaggcaaattacagaccaggaaaatgtttaaaatttatatcataaaatgcaattttctgattatataaataacttttagaaatgaatacaaaaagaggccaaacaccagaaagaaaagaatggacaaaagctatgatgagggaaatacaatttgaaatacaaaaggtaaggaaaggaagagaaagaagggaagagaagtcagaaaagggaaggaaaggaatatgctagaatcagtttccatgagaaaagaaagaaaagtccattttctcagtttgtgtg

SEQ ID NO: 263736 - DNA, 735 bp, Homo sapiens
gattcaccacccacataggatgatttaatttcatgatagcaagccttcttgaattcatctacaaatttattacaattattatcacaactgtaatttgaccagctgattttaaaatgttcaaaatgaaagatcaactatggccaagataatgttgaagagcaaaaacccaaggggatttatcctgaaataaatatttataagaaaattaccattatagaagtgcatactgttgcagagacacacaaaccaatggaacaggacaaggagcttagaattacacctatgtgaaaacttgattcaccattgaagtgacactgcatgtcagtagagaaaaaatcgaccacttagtaatatgatgctgtgacagtcatttacatagaaatatttttaaagtttgatcttttatgcaacacacagataaaacagaattggtttaagacttcagtataaaagaaaaaaggtatattttattataacttttattaattatattgagataatccacagaacaaaaaatctaatggccaataaaagtgtaaaattactcattctcattaatgatctggcaaagggcaagtgaaaacagagaaaccattctaatcaaattggtagaaatttcaaaacctggcaataccaagtgttgacaagcaaagacagaaaagggaattttatgcacttctgctagaattgtaaaatgatatacccatttggaggaacattataacaatacatcat

SEQ ID NO: 263737 - DNA, 585 bp, Homo sapiens
attagctcaagtggtagagcgcttgcttagcatgcaagaggtagtgggatcgatgcccacattctccaagctttattatttagacatcgtgtctccaaacactcaggtctccaaacccaagttagtgtctgagaacaggatgctgctttggttcaagacgtaggagcagcaataatagagggctggtgatggctccctcttggcattcagtatagtgtagatctaccatgtaattaattctctgtttctttgaggagctgtgaaaccaagggacatatacaactgctcttttctccctgtttctacctgcagctttgtcctaaatgtgagacaattatgaaaagtgcagggcagagccacttgggtaaatacagccccggctttctgctcaggggacagagtttgaggcactgcagaggaaccagccaaagtatgagacccatatgttgagagtgacagtgtaaagttcaaaaaaatcaaaatgtttaaagatttatcatgggtcttgatgacatgatggaatctctctactctctggactgattatgtgtggtaataaatttactttttaaaagccaaaagagt

SEQ ID NO: 263738 - DNA, 448 bp, Homo sapiens
ctgagaggggcctgcccaggactctcgagactccgtgagaaaggcagaaggcccccaaaacagggtgtgcgtggccgttttctgtgttcctcaagaggtctcaggctgctagaagtctcctatgtggtactgaagatggtacaaggcaggagaagcacaagcagaggaaaacggaaggcgtcacagaggagccggttctcaagattttaggctttctaaaaggtcagtgacgttttacatttttcgcagcaaactcatgccgacaagaaaagcaaacaaagggaccaaacttattttaaaaggggtttcagtcgactgaaaaaatcccagcaacaggatccaggtaagaagtgtcagcacttagggaagctgaggcaggaggatcacttgagccgaagaatttgagaccagcttaggtaacgtagcaagactctgtgtctgccaaaac

SEQ ID NO: 263739 - DNA, 699 bp, Homo sapiens
aaaaagaaaataaaatcctgatcaatttagaatccaacacccgagtcctgatcccagctctaccacctgtatgttgtaatctacaacaagccaccaacatctctgagcaccacacctaccatccgtgggactgaatctgggattcccttgctcatttacctcccacttcttcctgaggagcacagggactgacagatgggacagtgcagaggaaactgtgcacaactctcctccaaagacaaactacaacacctggacacgtctctatattgatgtttgtagtgggttaattcaactctatggcagaaagactttaaacagtgcaagtgattccaccagcctcctcctcactgaggacgattaagtctctgccctcaaagggaacgcttctaacaatgagtgataacttaatgtttaaaggtatttcttggcagggtgcgggagctcatgcttgtaaccccagcactttggctggtggatcatgaggtcaggagtttgagaccagcctggacaacatggtgaaaccctgtctctactaaaaatacaaaaattagccaggcgtgatggcacatgcctgtaatcccagctacttgggaggctgaggcaggagaatcgcttaaacctgggcggcagaggttgcagtgagccgagatcactactgcactccagtctgggtgacagagcaagactccgtctcag

SEQ ID NO: 263740 - DNA, 738 bp, Homo sapiens
gcttaacaaatgtggttttatcattgcctttctttactgaatgaccagttaatataatccttgaaaagctgctaataaacgcctatcatagttcaactgatttataatttagcaattcattgtgtacttttgctcacaaatatgaatgttatatgatattccatcttatattttttatattagtatctccaatttcttattatctatgtagtattacatcacttggatgtaaactgactgacttaatatttacataatacaggaaattgtttttggacaaactcttcctaaagttcatttccaggtgttatagatcagtggttcaaaacatttttgggttgtatatacccttaatactctcataaaattagagacttttgccgaggaaaaaatacgcatgaataaaataaacatacaataattaggtatataattccaaggcaaattattccaggtgaagtatccctgttctagacagagcatatttgtgagccactgcacttgaactccacaaatttttgaattgcatataattttcacatgtcatgaaatattattctccttttgatttgttgtcaactattgaaaaagttaaaatcaatcagttcacaagccatacaaaaataggctacaagcagggtttggcctacagagccatagtttgcaaacccctgctatagacccagagaccattataccatacacaggctacacaattatgtaacttggaaaaaaaaa

SEQ ID NO: 263741 - DNA, 231 bp, Homo sapiens
tgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggct

SEQ ID NO: 263742 - DNA, 704 bp, Homo sapiens
cactaactagctgtgtgaccttgggcaagttatttaacttctctgtgccttagctgttatgaaggttaaataaactgagccatgtacaagaactggaacaagtcctggcttatggtgagccctcagggcatgttcactattcccctggccgctgagtcttggctcccaccagccctggctaggatgccattcctcttaaggcttccctgaccactgcaccaccatggggaattctcatctcagaacccctggggcactcaaggttgggcacctgactgcacatattcccaactggtctgggacccaggaatcttcctactgttggtgagctctgtccccagagcaccctggctcaggcctaggcacaccgagatgttgagaaatgcttggactcctcccctgcaggacgggcaggccaatggaaagagaaagctgttggtgaccctggagaccacccctgaccagggaccattggagctaagcagtggagcaggcacaggtctccctcccagctgccactccccctggtatccaggaagtccctgtacctgtgacatcacacttcatccacaaaaatagccggcgcatctcagcagcctgggtgcagcctgctctgtcgggtgacaggctgtaagtgcgagtcagcatctgctgggtggatgacacccctcccttctgaccccagagcagggacgcgctcaccc

SEQ ID NO: 263743 - DNA, 426 bp, Homo sapiens
ctgtcaatgattcagaattcgtctctgtcatccctctgctacttagcattcagtgccctctactgccctccccgactccaccaaaattctctcaggccccaacagtggcatggattctgctctcgatgctttcttccactttcctgtcaaaatgcatttaaatcccattcgccatgagtatttttatgagctgcttctcactagagtgattacgactgtccttaaatgtggcttaatgtttgccctctgaaagaatttgaattttaacagagaacttctgaatacgcaaaaccttcaccccaaataatcaatctttaagggatttcgggcgccaactagaaaagtaataagggcacagactgatctgtttgtatctgctaatagaaacacggatttttgtctattaaaaagtgatagaaatgtcta

SEQ ID NO: 263744 - DNA, 200 bp, Homo sapiens
aaggcgcggggacccgggcatcccccatgttcagaactccctagacgcgagcacatacacaaaggcgcggggacccaggcatcccagcacctcatgctcacacttccctagaacttgctttcccgttactgcagctcacaaagaaaccgaaaaaaggcaaaaccaactgtattaaaccttattagtgatcaatatctact

SEQ ID NO: 263745 - DNA, 351 bp, Homo sapiens
gctgaatactacaacatgtgttccagtagcatgcattatttagtaacagcttacacagctctaagttatcatctttcccacctcattcccaggaagatttgtttaatttataagcagtccatttcagacagcactcctcgggatatcacaatattgctgttcttctgggtgattcattggcattatgaatacccttgtttcttccatgggtaaaacatgtttcaaggccactaactgggctattggcaaggcctggtacaaactaagtgcaatgtaactcttagcaatttgtgaccattaaacatagcatttataatgtgctagttttaaagttgaacaaaacaacaacaa

SEQ ID NO: 263746 - DNA, 452 bp, Homo sapiens
ttggatatgtggggttgttctagcacttctctggcttctgggcttagggagtgagatgttcttggccctctaggaaggactgtctggctaggcatggttagaaagtgggatcatgaggagtcaccttctggggaagctgggggacaggctacaatcagaatccccacatccataatctaaaacaaatgtatgaccctgtttacactgttctagacaactgcttatattaaaatatttcaatcttacagaaaaattggagatagaagtacaatgaatgtctagatatccttcacttagagtcaccaattgttcacattttgtcctatttgtcctctctgtagatctgtacagttttttaaatgaaccattgaaactcagttgcaagttttctgaaagattttatataataaaatcaaaaattacaaagaacaaaaataaaaaaatgtaaatta

SEQ ID NO: 263747 - DNA, 311 bp, Homo sapiens
tttctagtgtttatgtgaaggcatgaggcctactgttgctacatgaaagctgtgagagtttcttctatattcgggtgggtgttgttcatatccttttctttggaagattatggacattgcattgtaagcttcctgaagaaatttaactggagaggctctttgtacttgtcttataatagggttgtaagtgattcatgagataggtcttcagagtactattctgcattatatttaagaaagaaacatttgagttttacaagtcagttgtttttcctattgcacattaaggtaataaaattcagtggattttg

SEQ ID NO: 263748 - DNA, 305 bp, Homo sapiens
tgtggatctacccttcactatgatccatccatagcatcctgcactcattctactctagcgttgctaaaaaattgcaaaaagacattcacccagttacctgtcctttcaccctattgcagtctccatatgcttgtcctcttgcctgttgtctttccagacctcagcagagtactagacatgtacacatcacttaatacatacatgtttctcaatgaatgcattcataggaatttcagaagacttcctgagattcctcatgtttacttctacctagcaagaatccttctaatgatggtttttcctat

SEQ ID NO: 263749 - DNA, 345 bp, Homo sapiens
gaaaattggctttttgttaattggcagatgttccattggcgctcagtttttgttgggatgtgttatgttgtatgtacacatatatggaccagagtctgctgaatttataaggttcaaaaattatggtaacatcttgatttttgttaatttatctcaataaaagcccaatggaactccaaaaaaagagaataaatataaataacattagataataaaccgacaataaatggcacagctttttttagagtgaaaatataaaatattgtatttttattggtgaaaaaataaataaaccagtaatttcaatgttagtatgaacctgattcagtaaggccagaatattaa

SEQ ID NO: 263750 - DNA, 456 bp, Homo sapiens
tactcagttctccttctgtcctggctcaggtctaggccagtcaagagggtggctgagaagcaggaggagcctcagagaccctcccctcgaaagcactggggcttccacctcacaagcggcaggttcgctttgggagctgctggtccatcgcccaggcctggccaggggcaggcgaggatcctggttgccgatccatcgtccaggcctggccaggagccggtgaggaacctggggctgttgtgcaggggtcgccgtctccagctctctgccgtggtgaggggattgtgctgtgtgcacaccaccgggctgcatcgaatcccaccatggcccagagggtggacctgtggctccttggggggccagcatctccagtctaatgggtgcccctgccactctcctgagttcccgtgcagagctccccccaacacctcagccttcacctttctcagttaatca

SEQ ID NO: 263751 - DNA, 418 bp, Homo sapiens
aaagacagatgcttaatctgttctggctcttttttaaaaaaaatgtagttgacttttgttctaaacattttttctcatttcctttgtgatttcttctttgacccattagttacttacatgatgtttaatttctacgctttggtaaatttcccaaatttctttctgttattgatttctagtttcattccattatggttggaaacatatttttgtgatttcaatcctgttaaatttattgagcctttttttatggcctagcgtatggtctagcctggagaatattccatatgtacttgagaagaatctatattctgctgttgttgggcagagtgttctatagatgtttcttaggtctggttgcttttagaatattgttcaagtcttctatttccttgctaatcttctccctagttgtcct

SEQ ID NO: 263752 - DNA, 471 bp, Homo sapiens
acaaccaggtgcatgttgcctttgggccttgtgtcaaaatatcttcatcatctaagaataaaacccccaaagaggtcagcctgatcttgtagaaagccgtccctgggaaaatgattaaatgtcagtaaacaagagcatttcagaaactgacatggtccctaatgtttgtgtttagagactcctaatgtgtcagaattgagttggagacttacgatgtaattgcatgtcttgtatttcatgccagcctctcggcttggtgctggggcagagtgggaagcagaccacagagcagagagggcctctgccctttatgttctgtgagagagatggatattcacaaataatcctgtccctaattaattgcagctgagataaccattataaaagaaactagagagtgtgacaaggggtgactatctcttggtcttggttgtcaggcaatgctatggaagggttatttagagtcgtaga

SEQ ID NO: 263753 - DNA, 648 bp, Homo sapiens
caactggtaacatgagaggattaaatgaagataacgatcaagtaaaataactggcatagcacctggttctaataggcttctataaatgctgcttcccaccactcctctctcttccacctgtttcaccttttgagaaccctgaatcatgacttccagctacattatgcctgggcatcatgactattcagctccctgaagggaatgccttctgatgattgacacttagtatctctttcttactcctctgcctatccccttgtcttattcccttactactctcaaccaggaagctggagtagctgaaagtagatttcttccaacacgaaaatgcctaggtcattaggtacataagaggtgctaactaactgataaataaataaggagagagacagagagagaaaggaaggaaggaaggacaaaacctaagatagtataagccactgctaacctgtgatgttagatctaagacgtcaaagaggaactggagtgctggtgattccaccactgtgatgccttgctgtggtcacagtgcaagcgctgggtatatatgtcattctaaactggagatataggacctatttcatgtgagaacaagcctgtttgatatcagacatcacctggtcaagccctagcattgaccattattcc

SEQ ID NO: 263754 - DNA, 234 bp, Homo sapiens
acttaaattaagacctgaaattgaaaaactactagaagaaaacaagctccattacattgggctgggcaatgacttttttatgtttttgtttttgtttttatcattttaaaaaatattttattaaccattccagagttctcattaaagagagaccatcctgtcatttcctatttttgcagcctgtgcctgatgggttacaggttgataaagcagtaatcctcgagaaaattgacc

SEQ ID NO: 263755 - DNA, 521 bp, Homo sapiens
ttacccaagagggaatttttttctcaggagagtgaagaaagcctggctttcctcatcagctctctttgtgttgaattcatcagtcatgacaatcatttgagaaaccttagaagatcatcccaaacctggaaaaagtcagttacattaggaaaggagtgagcataaagagcacctactagagagagggtcctttcacacacatgacctcatgtaaccttcacaatcatgccatgagagtatttacagcctctgctgttgctctgcttctatctggtggattaaggaaagtcacaactcacagccctagtggaaagttacaactgggatttgagctaacgaagagttgaagactcagcaacaggcgcttggcttcactattaacctggacaaggccattaactcgcctgtacttaattggcttgttctgtgacacactgttgccccagaaacacccatatgggtgtaccccacattaaagaagcccgctctatgaaaaccgagacttgttgaaaagataaatg

SEQ ID NO: 263756 - DNA, 708 bp, Homo sapiens
ctgccaccatggaagaaggatctggaaagaaggatgggatctcagcctgatggcaggtcttacccaagagggaatttttttctcaggagagtgaagaaagcctggctttcctcatcagctctctttgtgttgaattcatcagtcatgacaatcatttgagaaaccttagaagatcatcccaaacctggaaaaagtcagttacattaggaaaggagtgagcataaagagcacctactagagagagggtcctttcacacacatgacctcatgtaaccttcacaatcatgccatgaggtgggtagtattatcaccacccctatccccttttttggaagaaaggttgagtaccagagaagcaggggtgatattcaaactctttaattagggttaaggtatgggggctgaccaatcagagctgccatacagatttgttttatcagagaagtaaaggccttggtcaggatttgaaatgaggctcatatgactgcaaagctcacattcttttcaccgcaatttgatttccttatgccagctgcttccccagagacagtgacaccaactcttctgggttgttgagagggtaaacaaaccgtgatgaatgaatctcctctcctaatatgaatgccttattgttgttattcttcatgccctgacagagtatttacagcctctgctgttgctctgcttctatctggtggattaaggaaa

SEQ ID NO: 263757 - DNA, 615 bp, Homo sapiens
aatatatcattttgacatatttgttttctttttagctgtttatttgctgtttgggtataataaatcattaccctagtacttcacatatatgtctatataagtatacaggtaaacatttcttgctaaaagagctcttacactgtttctttaacttttacctgtggtaattggtttcttaatgaattatatcaacctattaaaaatcacttacacagttgtctttagtattttgagttcttagggtgttttgaattactgaatagacagactagaattttagttttaaattaatttatttaaattataccaaggaattgataccctgggttttctgggtttattttacctagttgatattgataaaatttcactgctattggactctgtggttaaaataactcttaggcaagtaacattgtcggtaatttgaataaattttctcttgggttttggggtaagggaattaatatgggaatcaatgtgggagaccaaaaatatattgagaagtaggatgaaagtagttagttaatcttctctattcttactggagctttccatttagtctatattttagccttcatattcagggttagaaaatttaactgaaaaaatcat

SEQ ID NO: 263758 - DNA, 751 bp, Homo sapiens
ggattacaggcatgagaccgcacccgaccccagtgtggaatattggtgcccaagtgggttaggagggcatccgcatgggggaggtaccctggagttcgatgttagagcctaagcagggtgagggagttactgcagagagaagggattagagggtggcccaatgtggggtgttagagctggaggaatgtaaggaaggcatcatccacacagaggaacattagcccagtgcaagggtcaaagcctgaggtgggtgaagaaaatacctgctttatactgttctggaaactcttctataagtttgtaatcatatgtacccaaaatgtacctgtatttcattttgtaaactgtcacaaaattaatatttccaatgcctcatatgtttttaaaaaatatgaaactattatttatttgaatatattacatgaaactcctcaaagacatctctgattaaagcaactttgccatcacagaaagtcagtttattttctataatgtatatattttactaattataatctatactgcctttcatctatatagatgttttttattttaattttcagtggaatagaactaaagaagtttattttttcacaactgttctctggtactctttttaggtttcaaatgcaatctgataaaaattgtattttgaggaaaaaatatcaggcacactgctatccctcccaaactctttgagttttgtaaacaaaattttcagttcaccactaatactgacaccacagcacag

SEQ ID NO: 263759 - DNA, 555 bp, Homo sapiens
  misc_feature (264)..(264): n is a, c, g, or t
  misc_feature (524)..(525): n is a, c, g, or t
tgttatcgattgccaccttagttaatccctcaagcatgaaagctggatcttttggggtttaagaagcccagagcttgttcctgtcctgtgctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctngcctgcctgcgtggcatcgataaacaccggtgtttatcgatgccacaagattccagccttccttcctgggtatggaatcttgcggcatccacgagaccaccttcaactccatcatgaagtgtgacgtggacatccgcaaagacctgtacgccaacacggtgctgtcgggcggcaccaccatgtatccggcattgccgacaggatgcagaaggagatcaccgccctggcgcccagcaccatgaagatccacaccgagtacnncgctctgggggtgcgatgatcttgatcgtc

SEQ ID NO: 263760 - DNA, 343 bp, Homo sapiens
ctggggtgggacccaacagtctgtcttttcaccagctctctagtttgagaaccactgctcctaaactaattatatcatttagatgattgggaaattggctctggaagagctgcgtacaaattagaaacactgaagagtagaactcgggtgtctttgttgccactgttactgttctcctcgctaagaggagcagggtctaggcatgggctaacgacatgtgaaacttgaggatttcagcataattcagaagcagagttccccaatagtaatagctaacatttattgagcactttctttttttcatgcactttacaagcaccatttgaattttataacattttgc

SEQ ID NO: 263761 - DNA, 406 bp, Homo sapiens
gtttttataaacttaaagcaccatgcaaatgtgtagagctcttgcagatgtaaatcctctttacagaagtcatggagaaaattagtttgaagccctggttaatcatgtttttaagatatatcaggccgggtgtggtggctcacacctggaatcccagcactttgggaggctgaagttggaagattgcttgagcccaggagtttgaaaccagcctgggcaacaaagtgagaccccgtctctacaaaaaatttaaaaattagctgggtgtagtggcatgcacctgtggtcccagctacgtggaggctgaggtgggaggatcacttattgagcccaggttgaggcttcagtgagccatgattgcaccactcctctacagcctgggcaaccgagtaagaccttgtctcaa

SEQ ID NO: 263762 - DNA, 279 bp, Homo sapiens
tctacctgtaagttcttgtaatttgggattgggattaagaaactccagaggctggtgtaaattgatggggcaccagctgttgtttgctgcacctcagggaagtcatggtgggagtctggcctggccctgttggctggggcccccaacagatccttgctgtgtctgggtttgagtttacgctacacaattacaaactttttccagtgctgctttttgtgaatctttgaacctgcagttgtgaatgaacagaaatttgaactgagcttaaaaaaagaaaaa

SEQ ID NO: 263763 - DNA, 368 bp, Homo sapiens
atcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaagtaagtcagccacaaaagaacaatgtatgactccactgatgtgaaatctccagaatggaccaatccctacagaggggagcagatcagtggctgcccagagcttggaggaggggaatagggagtcactccttcctgggcaccaggtttcggtttggggtgatgaaatgttgtcgacgcggccgcgaatttagtagta

SEQ ID NO: 263764 - DNA, 675 bp, Homo sapiens
aagtggaagtttccctttactttcagggattggtcaggggtggcagaaaacatgtgggttctttgtgtagatgtggctagttccaattagagaagtcctgcagctgatgttgccctcaccgtgatagcaggaggatgttgagaaatgggcttgggagacctggaggagaagttaccctcggcccggacgttgccttcctttcatcacagggcctttaactcctcctagggagtagcagagtggccctagggaaagtggccatcctgaaacctagtgttgctgtgacctggtgacagaaatggaaacctctgtggctcttctggtcatccttggtgggagtgggaatggtgtcacctttctagagggccatctggcaccatgtaatcacgccacagatctttacgaagctcctgctatgtaggaaacactatgcctggcactgggtatccattaaaatgtaaaatgcacgtgacctggcaattccacttctagaaatgagccttcagaagtgctcatacaaaagagctcaataagtatcatgcactaattcattgtgccaccagagctccctatgcagccttttaaaagaataaataggatctgtagcaccaaacaaaagacaaaaaaaaaaataaagggagaacgcacaaaagtacccagaagggaccaggacga

SEQ ID NO: 263765 - DNA, 646 bp, Homo sapiens
ataaatgctatgaaaattctgcacaatgtacttacatcaataacatccttttgtctatcaagcaattcctaaacagaggaaggagactgagtttgagttcctcattaaaaaattaaaaaataatgcctcaattaaaagaattcaaggatttatcatataattcattatgaaatcatgaaactataaaagaacctgagaatgtatataaactatatacatatatgccttactctcaggaggcctacaagcaatttcttttttttcttgacaacaaagtaaacacaattatttttacgttttttaacattttcttaagtatttaatatattagttacagtttcttgcatggtgtttgtaaaatattaactctggccacctgggagcatggcaatactacatggagaaggaaacaaaaaggaaatcaatgaaacctattcccaatataggatcccagttcaaacaccaagagacttaaagtaagtaatacctgaaaatttgtccatgtccttgaaaggcaagctatacacaagttgttggtcattctgttgtaataaagtagctccaggtatatgttgtttaaccagtgaagaaagagattctgtggcacaatatttgtctatgtacatgctagagaataccaaaaatc

SEQ ID NO: 263766 - DNA, 1263 bp, Homo sapiens
ggcaagtgaagtcctactaggtcgtggctgcaggttttcaaactccttgatttaggtttgttattatgaccactttgctattcccaaggtgatctctaggatcatttcaggaatgtatgaagatagtcatgaatgtactgagtgttcgtatcctgcttcagttcaccttggctgtgcctacatgatgacagatattggtgtttttttttttttgagacagagtctcactctgtcacccagcctggagtgcagtagcgcgatctcggctcactgcaacctctgcctcccgggttcaagcagttctctgcgttagccttctgagtagctgggattacaggcacctgccactacgctcagctaatttttgtatttttagtagagaaagggtttcaccatcttggccaggctggtcttaaactcctgatctcgtgatccacccaccttggcctcccaaagtgctgggattacaggcatgagccactgtgcccagcccatgataacagatgtttgaaagggaataaagtcgtgtctagtgtcattgtgctagcgtgcccctcccccttcagtgttggccccagatcttccctttatttttttatgtttgtgggaaaggggccacatcagcagcaatcatcaaccaatcaataggatctacttagtggtgaacatattggctgtttaattggtaagagtcgctggcctgaccacaccacagcatggccacttgggttcctgtagagatggcctcagtttccaatgttcctcccagacgtttgcttcttgcccaatcgagaggggatctcaagactcctgattggtcattgtgagctctcaccctgcgtggctgtgtagatagactgcatagatacatgaagtggggatgggggccaaggtcctattactgctgtttggaaataacttgcctcttacagatccagccttattgtttttctgacatcctagtaatggcagatcctgcacaaagtggatttcagagttaatactgtgaggagacaaaataatgagaatagttttaccaaagacaatgaaatattgcataatgtctgcattttgccattgatttgagtgcatctttagaaaactgaatttcacgaaaacccaggacattgctggaaattgtatgccctttagaaactttatgtgaatttttatacaaatgctgttttatgagttatgtaaaatgttacaaaaatagaaaaaaaataccctgtgtctataaggtggtgctgctgttgaagtcgt

SEQ ID NO: 263767 - DNA, 552 bp, Homo sapiens
ctgccttccagggctaagcaaggctgtccttggtgtggcttgcagactgaattcagccagcatggtgctatttgattttacttacaacaaacaaacaactgttcagattattagacaatggaatgggaatacctttggagtcacaatttctccaattcgccatgtctctctgttgctctacaactgtaaggagagaaaaataattagaagaagagtctccctcaatagagaggcagacatacacacctggtgatcatcactgtggtcctgcccaccctggcacaggtgggtcagacaaacctggtctgattctgatttactttgcctgagggagttaacaaaggtttcagagagagggaatcagaaaaccctcatgtaaaacagataccatacatgttagatcgaattacaatggagtaaacatttctttcttattaatgttgttagtgctgtgtttcttgtcctattcagtgacatgctttgacctagtaatttttatacgtggactgattttcagatgcatgtgggcataaattaaataccaagcatcta

SEQ ID NO: 263768 - DNA, 376 bp, Homo sapiens
atctgagtttcagggaaataataaagagtggtcagaggtgcagcaaataggatagggactgtccctgcctaagcttgcaaacaccagctccagctatcacgtgcaaatgctggcacaaaatagccagacattcagattttccaagagaagctacaaaaccaaattggtatgtaaatctccttaattctaaaatgttggtagctaaatgatttatttcaaaaccattattcagacaaacacaatatggcctacagtgaacataacttgtatgacaaatacaaccagcaagctattagcttgagtgtttacctgagatagattaaaagaaaaataggctgggcatggtggctcatacctgtaatcccagcactttggg

SEQ ID NO: 263769 - DNA, 428 bp, Homo sapiens
ttgaaggttgtgggtgaggtctaaatctcgcttcttgctgttggcgtagagaaggtagcctggagtcaagtagtcaggcttcatgcaatcaacatggccccggctattgttgaccgtagtgtgaacttcactatcagcaaagggcaacacattctgcgggctcaaagtcaagcagatgatctgcttgatccagaccatcagttactggatcagtcacagtcctccagagaagcagaacccataggttacatatttaaggaactgactcatgagattgacaggtctgaaatccgcagggcaggcagcaggccagagaccccggcaagagctgatgcttcattcttgaggcagaatttcctcctccctggaaaaccagtgtttgctcttagggccttcagctgattggatgaggcctacccacattctcc

SEQ ID NO: 263770 - DNA, 536 bp, Homo sapiens
atttcttgttgttataaataacaaggggagaggaagctagttccagaggacatctggaatgaaagatcgttcactggaattttttagagtttgattatgaaatacttattaatctggattctctaatctacagtataatcctgtcgttgtatgtagctttgagatacataaggtttcagattaaaaagtctttccatatgtttataaccagtcacataaaggtcgtgtattttactgaaatgttttgagttatcttaatgatacttagcttctttcataaggcatatagtcacagttgagctaagtagcaggacacacagggaagacaatgcattattaattttagaaatctttccctttaccattcttgcaaaattaatctgatactaaaatatgatactaagaggctgggcatggtggctcattcctgttatacctgcactttgagacgccaaggcaggtggatggatcgcttgagtccaggaattcaaaaccagcctgggcaacatggtgaaacctcatctctaccaaaaaaa

SEQ ID NO: 263771 - DNA, 423 bp, Homo sapiens
actaactaccacgatgacagaggaaaaagtaacacaagaaaagaattactttttaaaaagttaggaaaatggacaaacaccccggaagttgaatttgcgtactttttaatgtatttatttttatttattttttcaagatggagtctcactttttcacctaggctggggtgcagtggcacgatcttggctcactgcaacctctgcctccagattcaagtgattctcatgagtagctgggattacaggcatgtgccaccactcccagaatcccagcttcttgggaggctgaggcaggagaattgcttgaacctgggaggcagaggttccagtgagctgagatcatgccactgtactctagctacagcttgggcaacagagtgagtgagactctgccaaaaaaaaaaaaaaaaacacacaaacata

SEQ ID NO: 263772 - DNA, 1296 bp, Homo sapiens
ggcccggacccgggaacaaagggggccgggcagccaatggcagccgggcagctccgggccgccgccaatcaccgagcgccgcacgcaccttcgcggcccgagcgcggcgctggcaaggtgagaggcggggcggcgtccgaggcggcgccctgctgggcaagctcagtgaccctgacctggtctccgaagggattctctgggcgtccacgggccggcttctaaagagctgggatccccagcctccctctagctgaagatggagaagaactttttccatttggcaatttgtacctgtgtttgcccaggactttttatttgggtcaaggggaatagttatcccaatactaacttctcagtttattttcagggtaaagagagaaaaaaaagagagagagagagattgtagggatcgttagggattcctgtgatggaccttgggcactaaattcaatattgcgttgtggagatgccctttcctcaattgcttttttccacaatcccaaatactgtcaagaaaccgtatcttacatccctaaagtcagcgaagattcttagattgttttctgagcattgggttgttcaaaagtaaagatgatgtgaatcacttcagaaacaggttgtgtcattcctttggaagcagagggttgccctttgtctctgtgtgagatggtgctaggcctatcgcgtgctcaggctttgatgaagcagagtcatcacattggtgcaccaaagctgaattcatttcatgccctaattcaggagcaattgcatctaataccatcagattggtcggtctggaagggagcctaacgattacttagtctagcttcctcactttgcagggaactgaggactccagaggtgcagggacctgcctaatgtcttagcctgttggggacagaggcattgctcatgaatctaaacaacttctcaaagatgtttggggctggaagcacagcatgttgactaaggaaaaagagcagtcaattttcttcaatttgtggttatggcaaaaaataacattgcccagacagcaggtgacctaatttggcacctacttttaaaaataacaaaacaatataaaacaaacaaacaaaaattccctaataatgcagatattcaggtccagatgtatgtctgccttgcctcgagaaatttggtagctaaaaatatccaaaattcattttagccaatacttgcaactctgcttacttgattatttgttaacacagagcattgatttataatgtgcatgtttcctttatcctattaagaattaaaactgaaattaccaaa

SEQ ID NO: 263773 - DNA, 396 bp, Homo sapiens
  misc_feature (396)..(396): n is a, c, g, or t
agcactcaccacccacaggccatcagaggtaggggatacctcatccagcccttagcaaagcgggaacgctttctaagtgcctttgctgggtaccatctctctaggaatatcatttctctctgaggatgcacagtccattttttaaaactctggttgttgaaaataattataattataaaagctttcttttttattttgcagaagccctcctcctgtggggaaagcacggcagacttcaggcaatggtggttggacatttgccctgccccttattatatggtcatgtccacccccctcacttcagtgggcctccgtttcctcacggggttgttaaaatgcattaatcattaaaattattggcctcgttggcctcagcggtggagctctgcggccagn

SEQ ID NO: 263774 - DNA, 116 bp, Homo sapiens
caagaccttgtaaatcactacatatttacttatcaaatagtaggtatttgaatacctgctatctaaatactagctgtacctcatatttaaacttattaaacactgggtatttaaac

SEQ ID NO: 263775 - DNA, 234 bp, Homo sapiens
gagttgctataatcagtattaatctgtaaaatcacattgatttatcttagaaggataaaaagaacagaaacaaaactctaccagctcatataatttttctttgcaaaaattttttgcttctttactatactgaattagttacatcaattgttgtatcaatgaaataattaggtattattacctgtaactattttgaaaattaataaaagaaccaagaagaatagagtaatatcc

SEQ ID NO: 263776 - DNA, 526 bp, Homo sapiens
gagtaaaataacatctagttcatagggttgttgactagtacctggcccatggtaatcactgtgtcatgttggctgttactaccctttaacatgatttgctcccctccctgtggtaaaaagtattcattggcactactaattaatctgttagctcaacatatactaaccaaaatggaaatttgttttgtgaaatacaattgtcagttccttttcattataagaaacgttagtttattagtagtatatacccctgagaaagcactaatttattttgaaattgagtggattaattcataatatgaaagctgagaatgtagattgtcttctttctctattttgaatagttcatagaataatttatttcttttatctgggaacaaaaataactggtctaatttgtgacattctcaaacatattttacaagtttagataagttgagaatggcaaaaaccacaattacttttgcaacaatctaatacttttagaagaaaaatctatcttaccttattttatactaaaaaaaaa

SEQ ID NO: 263777 - DNA, 2067 bp, Homo sapiens
agtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgctggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggc

SEQ ID NO: 263778 - DNA, 510 bp, Homo sapiens
actagtcacggttggcttcctgcgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggc

SEQ ID NO: 263779 - DNA, 399 bp, Homo sapiens
cacgcatgtacttctctaagaggggaaaataccagttgataatttgtagaagtacctataatacatcctaatgttgttttagtatgccatttaccctgtgttccagaatatgtacttgctatgccttgtttataaaataagttttaatgtatcaagcctctgaaagagtaaattttatgacaaatctgggaagtcatgctttatgtactgggagttcaaaaaattattttttgagtctgttgctttctagtcatttgtcccaacttaatattttaatatgtatacatcttgtataaaacaatttctaaaggattaagttgtataaatttatggatgaacactcaaagacttttgtcaggtcatatttaaaaatatatagtttcctaggagaaaaaagtt

SEQ ID NO: 263780 - DNA, 573 bp, Homo sapiens
gtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagaaaaaaa

SEQ ID NO: 263781 - DNA, 758 bp, Homo sapiens
ggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaaaatgattttt

SEQ ID NO: 263782 - DNA, 1016 bp, Homo sapiens
gtaaccaggctcatcagacctcccatcccctcacagccacagacccagctttaagtttcccagacggaagattattcttactgcagatcttagcaacctcagcacatgactctttttctttcctcattaagtcaagaacctttggccttttcacttaaaagaagcactctaaggcttcgctttgacataccccagttgccagcatcactactgtttgggaccattaggaagtaaattcagggagacttgaacacaagcactgcttatctcgaaagctgatctgctcaccgaggtggcccttgagcacggacagcctggatctgctggggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaaaatgattttt

SEQ ID NO: 263783 - DNA, 805 bp, Homo sapiens
gtaaccaggctcatcagacctcccatcccctcacagccacagacccagctttaagtttcccagacggaagattattcttactgcagatcttagcaacctcagcacatgactctttttctttcctcattaagtcaagaacctttggccttttcacttaaaagaagcactctaaggcttcgctttgacataccccagttgccagcatcactactgtttgggaccattaggaagtaaattcagggagacttgaacacaagcactgcttatctcgaaagctgatctgctcaccgaggtggcccttgagcacggacagcctggatctgctggatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaaaatgattttt

SEQ ID NO: 263784 - DNA, 822 bp, Homo sapiens
gggtccccttggccaagaggagggtctgttctgtgggttgagagccttaggattttatttttctttcttcttgttcatgccttcaacaagtataaagccctttccatcttaactaagcacttatcacacactgtggctgtaacttctgcagcttgaggtgcgatggcgaaagtattattaatttctttttccttcttcacagtttcccagacggaagattattcttactgcagatcttagcaacctcagcacatgactctttttctttcctcattaagtcaagaacctttggccttttcacttaaaagaagcactctaaggcttcgctttgacataccccagttgccagcatcactactgtttgggaccattaggaagtaaattcagggagacttgaacacaagcactgcttatctcgaaagctgatctgctcaccgaggtggcccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgc

SEQ ID NO: 263785 - DNA, 678 bp, Homo sapiens
gtcaaatcccaataaagacaatgttaataatgacatgaattttcatcttgccattattttttctaattataaaagttagaaaaagttaaattaagatattacggaaagaagtaatctaggaagtaaaaatccttcataatgccacctcttttgttgctgcctatatagtccttcagctatttttctatacacaatgcttatattgttactgtcttatttttatagaaaggtatcatgcaaaacataatgtttgaaatttgattttttacatttaacagtgtatcttaacatattttcatgctgctacatttagttctatcttttaatgtttaatggctgcatgctactccattaaatgggtctgtaattgttttcccttaatgatgaaattttgagtttttatctgtcaaaacaaagcaaaagggaatattcttgtacatatatgttgctgatatggtttggctgtatccccacacaaattcaccttgaattgtaataatcctcacatgtcaggggtggggccagctggagataactgacttatggaggcagtttcccccatactgttctctcagtagtgaataagtctcacgagatctgatggttttataaatgagagttcccctgcacaaactctctcttgcctgctgccatgtaagacatgactttgctcctcat

SEQ ID NO: 263786 - DNA, 359 bp, Homo sapiens
aagtgcatgtttccgtaagtgcactttttccataagtgaggtgaatttcacttaattcatatcatttagctttaatttcctctaagtgtctttataaatggatgactaaatatttatatttatgctatcagatttgataacatgcatctatctatatgactggatgtgtgaatattatattggtcagctttcacccaggtggtcatgtcagaaaaggctgttagtttagcctgagtgtagaatttctatcttagatcacatatatcatgtgtcttcctgtcttatatccctgtgtcttcctgtctcaccaattatctagattcagtgaatggtgtgtggtacaagacttgtaggaacta

SEQ ID NO: 263787 - DNA, 498 bp, Homo sapiens
ctactgtcaacctgcctgactactatatccttggctttgaaaggttgtagtgtaaaagttaatcataggaattcggtcattcttgacatacccaacagagccaagaaaccaggaggaaaaaccactcagggtgcaaaatattgtctgaagaaagcaattgaaataggccctattatcctatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctctagcttcctgttgactaaattatcttccttacccctctctaattcctgttttccacatttcttccctgctatataaacccctaatttattttgtcagggagata

SEQ ID NO: 263788 - DNA, 308 bp, Homo sapiens
tgctttcaggagaactactaaatttaaaatttcaaaattggctatagaaggatccaggaatacttaattgttcaatgtctttaatatgtgtgcttcccctggtgctgaatcattagatgattagacttattcttatcctcaaaattctgccaccaagattggtaaacatcataattttaattaatttacataaatcatttacaatcttacagtatccaaagcaatgctaaatgttgaatgaataccaaatgacagccttatataagaaagaaggttaacagtaaaacaacgtagctttctttaaaaaa

SEQ ID NO: 263789 - DNA, 571 bp, Homo sapiens
gtgccgccgatatttctatggcatttcattagtcatggatgaccttacaatttctggacctccatctccactagtcattttttactccatttagcaaaccaattttaagtccacacttcggactcatcagaaatttattttctgaaatgtacagcctaatttattctatgattttaatgtcttttcctttaatctcttcctctcagtatacttactctttgacctcaagaagcctccaattccttaaccaaccttttcccccccctctctgtcagtttactctggctttaccgcttccccatttagcatagactctggcctgtcactctggctctgcagaaccttatccgtggatcagtttggccatctgacttctttgatttcatgggctgctgcatgctactgagtatataccattggttggtagcaccacagattgactcaagtaggcaggctcttgaagcagtttagcagccctggcggtccaacctcttccgttcttaaagactatttcagattttcacctcttgtcaaatactcagcctgtcacctctgctgcctcagcagaagc

SEQ ID NO: 263790 - DNA, 2092 bp, Homo sapiens
aatataaacatgttagtgtgaaactgttctaacaatacaaatagtatggtatgcttgtgcattctgccttcatccctttctatttctttctaagttatttatttaataggatgttaaatatcttttggtgttttaaagagtatctcagcagctgtcttctgatttatcttttctttttattcagcacaccacatgcatgttcacgacaaagtgtttttaaaacttggcgaacacttcaaaaataggagttgggattagggaagcagtatgagtgcccgtgtgctatcagttgacttaatttgcacttctgcagtaataaccatcaacaataaatatggcaatgctgtgccatggcttgagtgagagatgtctgctatcatttgaaaacatatattactctcgaggcttcctgtctcaagaaatagaccagaaggccaaattcttctctttcaatacatcagtttgcctccaagaatatactaaaaaaaggaaaattaattgctaaatacatttaaatagcctagcctcattatttactcatgatttcttgccaaatgtcatggcggtaaagaggctgtccacatctctaaaaaccctctgtaaattccacataatgcatctttcccaaaggaactatcaaagaatttggtatgaagcgcaactctcccaggggcttaaactgagcaaatcaaatatatactggtatatgtgtaaccatatacaaaaacctgttctagctgtatgatctagtctttacaaaaccaaataaaacttgttttctgtaaatttaaagagctttacaaagttccataatgtaaccatatcaaaattcattttgttagagcaggtatagaaaagagtacataagagtttaccaatcatcatcacattgtattccactaaataaatacataagccttatttgcagtgtctgtagtgattttaaaaatgtagaaaaatactatttgttctaaatacttttaagcaataactataatagtatattgatgctgcagttttatcttcatatttcttgttttgaaaaagcattttattgtttggacacagtattttggtacaaaaaaaaagactcactaaatgtgtcttactaaagtttaacctttggaaatgctggcgttctgtgattctccaacaaacttatttgtgtcaatacttaaccagcacttccagttaatctgttatttttaaaaattgctttattaagaaattttttgtataatcccataaaaggtcatatttttcccattcttcaaaaaaactgtatttcagaagaaacacatttgaggcactgtcttttggcttatagtttaaattgcatttcatcatactttgcttccaacttgctttttggcaaatgagattataaaaatgtttaatttttgtggttggaatctggatgttaaaatttaattggtaactcagtctgtgagctataatgtaatgcattcctatcaaaactaggtatctttttttcctttattttaaaataataattgcacctgacacataaacatagaccacccacaaccaaaattaaatgtttggtaagacaaatacacattggatgaccacagtaacagcaaacagggcacaaactggattcttatttcacatagacatttagattactaaagagactatgtgtaaacagtcatcattatagtactcaagacactaaaacagcttctagcaaaatatattaaagcttgcagaggccaaaaatagaaaacatctccctgtctctcccacatttccctcacagaaagacaaaaaacctgcctggtgcagtagctcacacctgtaatcccagcagtttgggagactgtgggaagatggcttgagtccaggagttctagacaggcctgagaaacctagtgagacatccttctcttaaacaaaacaaaacaaaacaaatgtagccatgcgtggtggcatatacctgtggtcccaactactcaggaggctgaaacggaaggatctcttgggcccaggagtttgaggctgcagtgagctataatcttgccattgcactccagcctgggtgaaaaagagccagaaagaaaggaaagag

SEQ ID NO: 263791 - DNA, 947 bp, Homo sapiens
gcaaatatacaatcggctgaagattccttgggcctcagagctggtatgatactgctctgtgagtttagtctcctcacagtgaatcagttgagaaggatggccgagggcccagtggaagagaaatgccttgtgattagaaaagagcgcatcgtggatatgttcatggcatagacatgagttgttttcctttgtatctgaacaatgggaaatgttggcgcaagtctttctttgcagagtctttctatgacagccaagagtctgtttgccattcaagaccaaaatgaggccatgtgcctgctacctgccaaggcttctgacgtggcagtgccagggagcagagtggcatcccaccacagaggactctgaccaaagcaaaagcttcgccgggaggggaggttactttccacccagcactgggagacagagccaggtattagatgagagaagactgagagcctctaggtttgcaggaatgcacttggctgttcttaggtttttgtgtatctttaactgttactctaatttattgatgcttaacttggggcctgtgtacttcttgtagtttggaggcccatgaatagtctttatcgaccctgggaaattgtacagaaaattgtgggtgagtcattcttgggagggaaccccagctcctcacaaaggttcctcgctcaccctgccaaggataaggaccattgctctaaattacatattattctgaatgtaatgagagcattgatactagttgaactatttcatcttgtagaacaatttacagttgtctagctcatgtgctgccctgtactgcgacatattcacttctgttggaggcctgcaggtgaccatggcttgcctcttgatgaccatgctcatgtgaaagcttggtgcccaaaagaaaaataaaaagcatctctaaagaatgagaattgtcaaaaaggaaaacacagtgt

SEQ ID NO: 263792 - DNA, 807 bp, Homo sapiens
aacctgggcgtcagagtaaaatcccagctctgccatttactacctacccaccagggctgctgttagatttaagatgctaaagatagaatgctgagcacagagtgaatgtctaagacctactagttccactcccctccccgataccattttcattctaccgttcttgtaactactctgggtttgagaattatggcaggagactgtgctaaggagccaaagtctaatctctggattgctgagaataaaaggaaggtctggggaaagaaaggagggagggcaagtgggcatgaagaagaacagagctttcattaggcaagtgtttatgggcaacccccacgtgccaggctctctgctgggtgttgggttatgcaggtgattaggacacaggcactgttcttaaggagctcaggtgctgaaggggaagttactgttgtggactaactggtctgtaagtcgtacatggggtcccgtaccacaggcaggcacagagcttggcagcagtgcgaccctggacagaattgtttgtgaaacgtctccccttccagacgaagttattatagctcttgtgattttgtgtggtgcctagatttcccccgttgtacactcagttcaggagtacttactcaagtctcactcaagggcatggggaccccaaacaccttgttcatgtgcaccccagggcccagcacactgtaggcagatgtgtgttgactgagtggtcttcagtttccttattttaagatgaagataatgttgatcttaacaggctgttgtgtggattaaatgaagtaatgtttatcaagtgta

SEQ ID NO: 263793 - DNA, 703 bp, Homo sapiens
attccatctatgagaaatctctctgttcagtcaccataagccagattgaagcaatgtagatagggtttgattgctaagaatggcagcttcaaactctatggaaatgaggaaatttgaaagagagttcagtttcagccaaatcatgcatgtgaggtaacgagacatcttttaaatgcagaacaaattgctacgcataggactgatcatcttattctccactgttgatggaaacttaggcagagggatttcattatgcaaaaacatcatgtgtttcttttttcctgtacaatttgagggcagaattgttggcagtaaatcaaataagtcatactggatgtaagttaaaatatagccatgtatccttagaaaatatttgcatatgtagaaagactggaaccttaagtagcagccatgatgaacacagtggaagaattaataggtgttgttaacagtagtaacactgaaatgaatcacagtggatttatgtaatacatgtgctattgaaggcaacagtgattacacttgaacattgttaacatatagctaagtgtcttagtctgtttcttgttacttagaataactaaatctgggtgatttataaataaaaaaattatgtcttatagaggctaagtccaaggttgaggggctccttttgtgagggccttcttgttagtggggactctctgcagagtcctgaggcggt

SEQ ID NO: 263794 - DNA, 1134 bp, Homo sapiens
gttccagaaaataggactgaccaagaagcagaaaagcaagatgaatgatgtgaagcttgctgtcttgggtggtgaaggaacaggcaaatctggtccctacatccttaaataactgcaaatacttggtagtgtctttgtgactattacacatagtaccttgaagccagactgagtttgacagagaaaataaacagatgtcaaacttcttgcatctcaaatataatgagaaatctgtttctgttacaaaagcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 263795 - DNA, 874 bp, Homo sapiens
gttccagaaaataggactgaccaagaagcagaaaagcaagatgaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaacgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 263796 - DNA, 1123 bp, Homo sapiens
attcggacagaaaacatcagaaggaaaaccttcatatggcccaatgtcaaagattccatctggtgtcattttccttgtaccagaagtatttaatttggcatttctcatgtgcctgctagctgactaatttctttcagcatctgtttacgaaatatatagctaaaatagaaatatttgaaaagaggaaaacctgaagatcagtaatctaaattaacagcaaaatataatcaaagaaaacaaaagaagaaaaataataaagatctcaactgagatcctcccattgtcagattttgacctaggaccatcttggaaagggattcttctgtgattcagaggtgaagcccttacagtgaggtttcttactaagcgattcattggagaatatgcttctaattttgaatctatctataagaagcacttgtgtttggaaaggaaacaactaaatctagaaatatatgacccttgttctcaacgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 263797 - DNA, 1226 bp, Homo sapiens
attcggacagaaaacatcagaaggaaaaccttcatatggcccaatgtcaaagattccatctggtgtcattttccttgtaccagaagtatttaatttggcatttctcatgtgcctgctagctgactaatttctttcagcatctgtttacgaaatatatagctaaaatagaaatatttgaaaagaggaaaacctgaagatcagtaatctaaattaacagcaaaatataatcaaagaaaacaaaagaagaaaaataataaagatctcaactgagatcctcccattgtcagattttgacctaggaccatcttggaaagggattcttctgtgattcagaggtgaagcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 263798 - DNA, 973 bp, Homo sapiens
ggctggtacggcccggaagttagggatggcctgggaggagagtctgacgagcaaggggaaggtagccaagtatggagtgaaatacaggcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 263799 - DNA, 192 bp, Homo sapiens
gactgcagactagttgaccagctacaacttaaaatttttctatatacattttattatgtgttcaactcataactcacttactctatataaagagagcatttgattattgttaagctgtactgaactatcaatagctgttcagtaacagctaccttagatactgatggcagtcgcccaggctggagtgcagta

SEQ ID NO: 263800 - DNA, 647 bp, Homo sapiens
atagattttaaaaaatgattcaaggtggataaaataatgctgtggaaaaggggaagaaattattgtagatatcatctgtcagtagaggattttgaatgacttgctcctttaaaaaaaaaaaatctggcctgaagttcccaattctcacccaatctttccacccccatgaatgacttatccaatgttccgtgattcactggggaggttggaaatcaggattctcttgcctggagttcctcctccaccttctcctccttccaaacccactcgtttaaggcacatgatcccatgacaaatttcttccaacttacagttcaaagagaagtcagcattgcacctgtcaccaggaaaggggccataacctggggagttaagaacctacactgacattacccactgggtgcagggaaagtacattaaccatctgcgatgagactgtttcctagctccatctgtccatctgtctccaggaactagtctccctctctatccagtacctggtggttcagctccaagcagaatttaccaaagcaaaacagcccccatgattcacaatcccagacttgtgacactttaaaacagctcacgtttagaaagataatgagtcacaggatggcagagattaggaaactcagggccagagaggg

SEQ ID NO: 263801 - DNA, 693 bp, Homo sapiens
aagagactgactttgtttttgattattcaacctttgcctggaaaagacaaaaaaccagtctacctgtccacctgtcttcatcacctatcacacagtaggcactgaatgactgaatgtccattaagggcagaggatcatcccttgtcatgattttcccacttgggcctagcattccaaatttaaagttcccaatgacagtggtaccttacctttccaaagatcacaagacccattttctccttacttcaatttcgcaagcatcattcccaatagatatctatgtgaaaatgttgtatttctaacccctcattagaaaactagaaaaataggccaggtgcggtggctcacacctgtaatcccggcactttgggaggctgaggtgggcagatcacttgaggtcaggagtttaagaccagtctggccaacatggggaaaccccgtctctacaaaaatacaaaaattagctgggcatgatggcaagtgcctgtaaattcagctacttgggaggctgaggtgggagagtcacctgagcccaggaggtagaggtggcagtaagctaagattgtaccattacactccagcctgggcaacagagcaagactccatctcaaggaagaaaaaaaaagaaaactagaaaaataatcttagcttcttattccagaattatttcctaagataaacatttgaggaatg

SEQ ID NO: 263802 - DNA, 1329 bp, Homo sapiens
  misc_feature (283)..(283): n is a, c, g, or t
  misc_feature (338)..(339): n is a, c, g, or t
ggacctggggcccagtttgagttccttgtggcctactggaggagggagcctggtgcgcgaggaacatgtcaaaatggtgaggagtgggggtattccagtgcacctagaaaccatggagccagggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccantgttcgtctggaaaatgggccggctgctccagtactcctgttgccccgtggtggnnctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaaat

SEQ ID NO: 263803 - DNA, 901 bp, Homo sapiens
ccgtggtgtgtcatgcaccgtgggtgtcatgcaattcctttcaccagccaacctgaaaaaagacctttctcttactatgtcatcagaaaccagacagacccgggtccctgcaaaatctcaagtgagcattttccccacaggaaaacagaatcttccactgcagctagagaaactccgaggaagagggacttgatgctttaaacatcaaaatgagaaggggagggaggaaagaaaggggggagtctgtgaggcacaacagagaattcccccaaactgacatgaccgtgaccctctgctcagagggcactttcgacagcccacaggtgccagaccccacacaccccatacagggcaggcacctcacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaaat

SEQ ID NO: 263804 - DNA, 469 bp, Homo sapiens
ggcgggtgctggcagcccccaaggtctccagggccagggcagaggcaagcaggtgtttctgatgtcccaggaaggaccccagagtgtggggacacagcaatgttctggtccttaccccagcacagcccctatcaagggggacccaacccccctgcaggggctgctggtgccctcgctgatgagtgggcactgaaggagcacctcagcgagggagccaggagttggggtgcctcagcccggccccccaggcttccctgagggctgattgctgatgccctgtgctctgctgctgacctattttccagcacattctcgactgggaaacttggcccaaatcctgttccctgttgtgtgcccagggccccgtccagagcatcgaggaggcacttggcacacaccactgtatggacggatgagctaatgaagtgaatgaatgaatatcataaaactaaatggctggaaggagaga

SEQ ID NO: 263805 - DNA, 145 bp, Homo sapiens
tgaaggaaacgtttttgtttggcttaacaacaattagcccaacatttttcagaaatctcttctagcttgtaagtatgaatatcttctattcactcaaaaagatgcacattttaatatgaccacattttctgtgaccaaaataaat

SEQ ID NO: 263806 - DNA, 548 bp, Homo sapiens
gctttatatttagacccaagccccgaactgccccgacaccccctgtttcctttgtgagctgagaatcttcccacagaggccagtctgggtcatctctttcctgtgatcaggtagggtccttcctgacaaggccctgccccctcctggccttgactacccctgggcagtggcccctggggtggacctgctctcctgctctgacaagcagtcatctgtcttagagcacaggctctaattacccctgccattagcctgcttggcaggactgcagatgttattaatggcggtgaaattatccaatgcctttcaaaactccccagccactcgatgtttgtccctgtgacctctcacagcacttcatttctttattcactttgctgctgtattgaatcttaaccttgagtgtgagataaaaaacaaggaggagaatgtcactctctccaacgttcctttattcccttcctcagcccctcaccccctacttatttggggatgtaacccagcaccatcctcactgccatgctgtttgtcagcagggagctcttgac

SEQ ID NO: 263807 - DNA, 451 bp, Homo sapiens
cctagacctggggtatttttctgctaatgtgtgtgttctgccttctttccctcacttttctctcttctgccagcctagaatgtggacatgatatctgagggtacagcaaccattttgtgtgcatgagagcaaatctataagtcaaataaggctttgtggaaaggcaggactctgggcttcacaggagtccctgcctgggactgcctactcctaggcatctttttcatgagaaaatttaactctctaaagtgtttctgataacatgcagttgaatgcagttccaattgttttatctcctcatcaattccagcgatggtctctaaaacttttttgatcatgacgtctatcagtaaaaaaaaattgaacacatcatatttatatacattcatttgtattttatttatttataaactatccacatgttctaataatatcttggaaatagagaaaa

SEQ ID NO: 263808 - DNA, 462 bp, Homo sapiens
tagcatttgttttgattgagcttagtatttatggtcattaaattataagcttcagaaactctctaaggctttattcttagtaaagaaagctttattcagtagaagaaacagtaacaataacaacaactaacctccacaaaaaatattttaattttggcaacccaatcgactcaaacctattatgtacacctaagttgcatggatcctaagaaagagaaaacgggaaatatagcagttattttaatgttcacattctagtaagttttaatgagtatattcaaccctgtttgataactaggtgtgctgcattgtcatggttcacgcaagtcttagtttcttaaaagaaaaagctgtcttcaaaagctttagattcctctgatcaagaatctcttctattcaattctaataaaattatttcatatacatgattaaggtgagtaggtagatgatagtgatggggga

SEQ ID NO: 263809 - DNA, 563 bp, Homo sapiens
agaagtattgcttcatttatttacttccatttttccaaaattatttgggtcggtttcgggagtgtttataggataattcatgactgtcttttcaatcagggaaatggaaaactaggaactacattttgagtttaaaaatgatttcctccttaaaatgtccatgtaacttttttttttttgagacaagtttttactgttgctcaggatggtgctatcgtggctcactacagcttccatctccctccccaggctcagattgtcctcctgcctcggcctcccgagcggctgggaccgcaggtgtggtggcttacgcctgtggttccgattactcgagaggccgaggcatgagaattgcttgaatccaggaggtgaaggttgcagtgagccgagatcgcgccactgcactccagcccgggtgacaaagagaaactctgacccccccgcccccaaaaaagaaagcagttgctgtgtgctgctgtagtctctgctctgtgatacaacttcagcatatatattcatttagtatatatgtattgggtagagttgccttgtgatactttagc

SEQ ID NO: 263810 - DNA, 1861 bp, Homo sapiens
atctgaagaaagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgacagcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgt

SEQ ID NO: 263811 - DNA, 809 bp, Homo sapiens
  misc_feature (691)..(691): n is a, c, g, or t
  misc_feature (700)..(700): n is a, c, g, or t
ggtttgggtcagtgctctccagcctgcattcttgccttgatgtccagccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggnccagagtcntggccgagtcttggagattctggctcggtgggggggccccacagggttttcctggcgccggggagagcggccatagggggggccctcttggtggggggccccctggtgg

SEQ ID NO: 263812 - DNA, 1893 bp, Homo sapiens
atctgaagaaagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtgccccagggagggagagaagggctcctctgggcactcctggaggttgtgctggggaggaatcctggccctgttatagctcagaggcccacactcagcacagtgtccccagcaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgacagcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgt

SEQ ID NO: 263813 - DNA, 566 bp, Homo sapiens
aaaatcaataatgtctcttatcttcagtgaggtaggaaagaaagccattccgaagtggcagagaagctgctttttcctcctgcatgctgcctgctagtgtggatcttggcataacagacactacttggcaaaagatccatccttccttttcctatactttgctcagcggcctggaagattgacctcaaaagcaaaatcacctggatttccttgccatttggctttcaaatgtgctcagccaatgacaggctggaaagaaattgacagctgggaaaagaggaagatttgtgtacaagatcccttccactcccatctcattacctgccatggtcctagcagtggctgttcttattatggccacaactactcttggacaggccaacatccacaactccatccttcaactaggcttcattaacactgtccctcacccttatctctttctgggtaggggtgataaaggtttcctgacatcagagttcctgagtgcctcatatattcttgttggtccctgaaccttgccccaacatcaataaaaagttccttcattaaataattttcagttg

SEQ ID NO: 263814 - DNA, 293 bp, Homo sapiens
tcttctctcctcaaagctcagtacatctttccacgttctcccttttcctgagaagtttactcactgagaagttcaggacttcgagaccagcctggccaacatagtgaaaccccatctctactaaaaatatatttaaaaaattagctgggcatggttgtgtgcgcctgtaatcccagctacttgggaggctgaagcaggaaaattgcttgaacccaggaggcagaggttgcagggagctgagattgcaccactgcactccagcctgggcaacagagggagactgtctcaaagga

SEQ ID NO: 263815 - DNA, 598 bp, Homo sapiens
  misc_feature (77)..(78): n is a, c, g, or t
  misc_feature (82)..(83): n is a, c, g, or t
  misc_feature (87)..(87): n is a, c, g, or t
ttagtaactggcatcaatgtgatgatgactctgacgtcacttggtatagtgcacacttataagcctcttaccccaannccannttcnagtgtaggtttactagtggagttggaatggtaaacattttgaaatatctgccacaggaacaatttccattttcttcattaatataatggtggaagaatattgagttcagaatcagatgtggctaacattagatcttttgcttattgattatttagattttgggcacattgcttaatctgagtgaatttattcatctgtgaggtgaggatgaccacaaaaattataatgagaaaagcactgttgggccgggagtggtggctctcacacctgtaatcccagcactttgggaggctgaggcaggtggatcacctgaggttgggagttcaagaccagcctgaccaacatggagaaaccctgtcactactaaaaatacaaatttagctgggtgtggtggcacatgcctgtaattccagctactcgggaggctgaggcaggcggaggttgtggtgagctgaaatcgcgccattgcactccagcctgggcaacaagagcgaaactctgtctcccattt

SEQ ID NO: 263816 - DNA, 443 bp, Homo sapiens
agtactcttaattccataataatgtatatctttggaatcttgacgattttcaactcttaatccatagctcaagtcttctgtctgatgttgaatgcagtgatcttccaagcaaatgacagtatttgaaccttcccttaaaatggtagtaataaaattccaaagtacttgttaagtgaaggcatattataaattactgatatttggaaatttctaagagtatgtcacttagaaatgaatatgtagtggttaatgtgactgtcttctattactgagaatatgtgaatcaaagcaggatgctaagatttcctttctttgttatgaatacctgtttatactaatgttccattatgacaaactctcctcactggcttggaagagtatgatatcataatctgagaaaatgttaaatgatgctttctaaattaaatgcttcattaaacctc

SEQ ID NO: 263817 - DNA, 461 bp, Homo sapiens
ccaatcaacgatggcagcatgcagcctcagaatctttctctctttctttttgagacagggtctcactctgtcacccaggctggagtgcagtggtgcaatcttggctcactgcaacctctgcctcccggactcaagtgattcttccgcctcaacttgctaagtagctgggattacaggcacatgccaccaagcctgactaatttttgtgtttatagtagagatagggtttcaccatgttggccaggctggtctcaaactcctggcctcaagtgattcacccgcctcggcctcccgaagtgctgggattacaggcgtgagccaccgcacccggccagaatctttctgaacacagtactccaagcagctgctctcaacccatcaggatacaaccaatgtgccctttctttttttttctttttctattttttttttttgagacagagttccgctcctgttgccca

SEQ ID NO: 263818 - DNA, 370 bp, Homo sapiens
catagaatattacgtgagtggcccaaagtcatgcacccactaacagtaaggttggcattggaattgaatcccaaaattttcaggctgttgatctactgtgctgcaatcatggcctggatagatggagccagtgttttctctcaccaaggactacaagtgcagacaagacatgccaacttcaccaggcctctttccttcttccccttctttcttctacctaccttcttggtccctagcgtcagtcaccctccctgacccatatgctcatccctctaagcacacccaagttgtggggctgcattgccaaaggggctgccactcatgcgaggctcatctaatatgcctggtgaccaataaatgtataaagtgc

SEQ ID NO: 263819 - DNA, 417 bp, Homo sapiens
cagcaccttcctccacctggacacccagggctgctactcagggccctgcccagaggacagctgcacgcctccctttgagttccatgcctgcggctccccctgtgctgggctctgtgccacacacctgagccatcagctctgccaggacctgccaccctgccagccgggctgctactgccccaaggggctgctggagcaggctgggggctgcattcccccagaggagtgtaactgctggcatacctcagcagcaggagccgggatgaccctggcccctggggaccgcctgcagctgggctgtaaggagtgtgaatgccggcgtggggagctgcactgcaccagccagggctgtcaaggtcttctgcctctgagtgagtggtccgagtggtcgccctgtgggccctgcctgccgcccag

SEQ ID NO: 263820 - DNA, 562 bp, Homo sapiens
cattctcacgggggttcaaagctttttcctctgaaacgcaatgaactgttctaccacttcctacacctcgagacaagtgtcaactatgtattttttagacaaaaaatttgaaagctttttatgttttatgatattttatgaacatgagcttttctatctgaagaactttaaagcacttatgaaaagtatgatgatactcatggggtcactttagagtacacaagaaaacagacgggaagaggtttgttgacatgaaatgctgacctgctgacctgctgtgagatattgaacacgttatttttcttcccccatggtcgttcttctgaccatcttgaaagatagccaagaaagctttttcttctaattatttccagttattgtaggttcattcagacctgcaattaaacaaattatccatgttttgagaatattgattttaaacattaaatgtttacatttctatatagagagaattcattctctgccccctaccaccagattttagccttaaaggcaagttatttagttttgcttattctcatacactgaacagttgtttagc

SEQ ID NO: 263821 - DNA, 530 bp, Homo sapiens
tcctcaactctttctgtgggtccttcagttcccaagcccagcatcacagagccccctgagcccttgtcctggtcaggagcacctgaaccctgggttcttttcttagcagaagaccaaccaatggaatgggaagggagatgctcccaccaacacacacacttaggttcaatcagtgacactggacacataagccacagatgtcttctttccatacaagcatgttagttcgccccaatatacatatatatatgaaatagtcatgtgccgcataacaacatttcagtcagtgatagactgcatacacaacagtggtcccataagactgtaatggagtttaaaaattcctactgcctagtgatatcatagttgccttaacatcataacacaacacatttctcacgcgtttgtggtgatgctggtacaaacaagctacagcgccgctagtcatatacaaatatagcacatacaattatgtacagtacactatacttgataatgataataaacaactatgttactggtttatgtat

SEQ ID NO: 263822 - DNA, 398 bp, Homo sapiens
cttttaggaactccatttattggacctgggcatgttcttttggaaggataggattcagataagcgagagagaggagacttcctttggcagaaccttggacaagctactgagtgttccttctgcagcgaaacaataggattctggataaaacatactttctaatgaattacttgacttcaggaaacttttttaacaactctaaagatccttcttccttgcctcagaatgaaaaaattaaaaagcatgaggtgaaactgctgttgaagagcaataaacaaacaggaaaagtgggatggacaattgaattgtatgggttgtatttatttgcaaagatactgttggaagtatagcagtcacatgctctattagactgctcctaaaccgagccttatttgaaa

SEQ ID NO: 263823 - DNA, 389 bp, Homo sapiens
aggacagcaagaatcacttgacaattggtttgtgaccataatggcatctataaacagaaccattgaaataatgaaaaaacatggagtaagcaaacaacatctcctggaggagataaacaaaaagcgtgaatccaactgcttggtggaacgaagcaatcaagtcagcttactgagagttcaaaagaggcacttcccggatgcctatcagtcctttactgataccacaaccaaagagcctgttcccaacagtggcaggagctcctggatcaagctgagtctccttgctcacatggagagaaagcactttccaccaaaaaataatgccatatttggataaagtgcatctccagagacacacggaaatacattctctttgattcttaaaaagt

SEQ ID NO: 263824 - DNA, 245 bp, Homo sapiens
aatggcctacagggacttagaagagcttattattctctaagccctcttagcgcagctggcagcgcgttagtctcataatctgaagaagagcttattattctcatgaggataaatagctcattagtgacaggatatgtgatgcctcaaacataaagtaaaagtctgtatttaccttcttcagcatatcatttaacgcacacagtacacttacaaatgaacaacattatcatgtttatgtgccagac

SEQ ID NO: 263825 - DNA, 414 bp, Homo sapiens
tcagagctgggttcatatgtcatgtctttagaaaaaccatccttggccttcccatttctgcagataaacagaaagttaggtcaggtcatcctgtacgatatattatccgctcacctgtgctttttctccattatgcttatcactgttatttaacaagtaaatatgtaagtagttgtctgcttttccccctgtaagcgcatcacctccatgaggtcctgtctgtctggtttactcaaaaagtttgagattttggagcactttggatttcagatgaggaatgttcaacctgtatatggagcccctggctaccacaaactgtaatggctaatggaaaaagccagggccatgatgtgggagagaaaaattattttgcatttcctcttcctggagagtcaagaatggcttgtgaaggag

SEQ ID NO: 263826 - DNA, 417 bp, Homo sapiens
ctaatatagtaactacctaactgggctttctctttgtcccccttcactgcactcccttgacagagattgctttttagaatgtgaagatttttcttttacttccttggttcaaaatatccagctgtggcccgggcacggtggctcacatctgtaatcccatcactttgtgaggccgaggcaggcggatcacctgaggtcaggagtccaagaccagcctcaacatggagaaaccccgtctctactaaaaatacaaaattagctgggcatggtggtgcatgcctgtaatcccagctactcgggaggctgaggcaggagaattgcttgaacctgggaggcggaggttgccgtgagccgagattgcaccattgcactctagcctgggcaacaagagagaaactccgtctcaaaaaaaaaaaa

SEQ ID NO: 263827 - DNA, 627 bp, Homo sapiens
caaatttgaggtgtctggggtggtctctttgccttgaaagatatttcctctgatctgagttaaatttttttctgactatgcaggtgatacataattccaatattttggaaaaggaaaaatgaatgcccccattctcctttctagttccttagacttcatcagctttgctgcatgtacaaggcaacacgacggctaagatttaaaaagtgcctctaaatactccctgaaggggggaaatttggatgagagggaggaggcagtgagggagggaaagtttaacactccccaaccccaaggatatcagagtgatagtttccctccagtcaccaaaactgtaccaaattatatatgtttaggatgatttaattaattactaccagcaagaatcttgtcccagatacccaaatatacaagctcccttctacctttttgttccatagatcccagtcaaggttagtcattttagcaaaaaggtgtttctttccccctttagttgagccttgggtctctcttccctctcttttggaagtggaggggttaaattttctttcttttgatgaggcatcttttgaccttctccttgggtccggtcacggatttctatttggcctctgcttgactggtggg

SEQ ID NO: 263828 - DNA, 513 bp, Homo sapiens
tagaaaagttgagggcaagaaagttgtttaggataaaggggatttaggataaagcagggatttacccacaacctctgtggttaccaagaacagggtgggaggcagccaaagggattcaggtggaggtagcaggaaccgggagggaagcctgtctcagagcagcagatgtggctttagggatgcaggagcttgaggatggggaccaaaaaaggggcgagtgctggaggagagaaactggcagagccacggaagcagaaaaggacaacttgttgagcaagaagatttgaagggaaaggacctgtgtcttgagacctgagcgggcaggcggattcccaaccgattacagacaaacccacaaaggaagcctgtggagagggggtagtggcggaagggctctaatgaaaacaattttgcaaccttacttatagcgttctccaaccttaaactaatagctattctgcactttaaatatagcattggctccagagaagactctgaaatctttatttttac

SEQ ID NO: 263829 - DNA, 691 bp, Homo sapiens
ggcatgtgggtattttagttcacactgtggtatttgaatagaaatgctttcacatttttgttttctgacgaaagagaagagaagctatctaacctcattttttccccttatttatccttattcacttattctctaggtggcatgtgtgtcattagcttaacccttatttttcccttaatattgttgacatacatggagaggtttgttaactaggaaaaccaggatgattatcctgcctcttttctgggcagtgatagtgcatttaatatttatcttagtgaataacagaatatgaacctcacttgaaaattcggtcaataactaactaggaaaaatggtggggagagggcatagagctaaaattaagaggttgaaattttggttaagtctctgccagggagaggctgtataaccatgagaaatgcaaataacctctctgcgagccagttttctcattcatagaatgagcaatgcattagattgatttaaaaatcccttttaattttcaaatttcatgattttgtaatgcttcagaagttaagaagagaaagaaattcagaaatgcaaagtattattcaggtgtaaggaatgtgagtcatttatagaataagcctctcacccaacagtgctatttttatttgtattattgacccatcgtatttttaaagttttgttcttatttatatatttt

SEQ ID NO: 263830 - DNA, 355 bp, Homo sapiens
cattcatactcacaaacctcccttcggagattatatcatcccatttcctacatgaggcttgtccaaggtcacaccgctaggaggcagcagggctgaaatttaaacccaggttgccctagagattgcgttgttcccaacaccctactcatcctcccagacttagcctgttcactcattaccttcatgagcactgtgggatctgtgaccatttattctgatatttacttagtctcttttcttaaatagagccccttttttatttaaatgaattacttttaaaaggaaactatatgacaactgtaaatgaaaaaatctcatcaatagtgtctcttgccaaaattaaaactctaaaaac

SEQ ID NO: 263831 - DNA, 527 bp, Homo sapiens
aaaatggggtactaatttacattcccaccaacaatgtaccagggtttcctttcctccataccctcatcaacatttgttatcccttgcctttttgataaaagcctgctatttatgacaaaatggatgaacccggagggtattatgctaagtgaaacaaaccagacacagaaagaaaaatactgcgtaatctcatatgtggaagctaaaaaagtcaaacacacagggggatggaggtggaagaaatgaggatgttggtcaaagctacaaagttgcagctacataagatgtataaatctagagatctcatgtacagcataagttctatagttaataatgctgtattgaatactggaaattttctaagagtagatttcaggtgctcttactgcaaaagagggtaattatgtgaggaaatgcatatttaatttgcatgactgtagcaatcatttcactatgtaatggatgtcaaaacatcatttgtacaccttaaatatatacaataaaagattttcaccaaaaaaaaaatc

SEQ ID NO: 263832 - DNA, 446 bp, Homo sapiens
ccccatgggtcccctgagctgaagctatgcaggcagggcccagcccccagccccagagacaggtctctaacagggttccccagggctccatggaaaacattctccctgtctgtgcaccctcttcacagagcagctgtaacctgggaggctgaattgcctatgactgagtggggaggctgagtgtgttggggctgggagtaaggcagatgctgattccatggtcctttcagaagcaaagggtctctggggaacacctgctccagaggctgtcagcagcacctgctggttagatcagggctggcctaggcagggcttcctccactgcagcactgccagcacctgtggagagacagttctgtttggtgggggctctcctgtgtgtgccttagcagcattcctgtcctctacccattagaggccactagtacttctccagatgcaacaat

SEQ ID NO: 263833 - DNA, 389 bp, Homo sapiens
gatctaagccaataaattcatggcattccctaggccatagggcatagttaaggaatgggcatataacccaatttggaataaagagttgtgagaggtttgtttaggaattcagagaggaggcttttttttttttttttaaatgaaagatgacaatgagcttcttttttgcctctgggtgttgggtgtgttgttgtgaaaccaggaactgttacatttcttttgcttccacgagagacgcaatcgatgtaaagatgaagacatcacacagaagagaagagaactgagggaactacagagaaatggagctagagctgctgggtgaagctgactctgaggcttctcataaactctgtgcttccagttgtgaaaataaatgcagttctcatttc

SEQ ID NO: 263834 - DNA, 578 bp, Homo sapiens
tatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaa

SEQ ID NO: 263835 - DNA, 382 bp, Homo sapiens
caaaccaaacacaaaattaatagaagaaaagaaataatgcagcctgggaaatgggctgatctcatctctaaaagaatatttaaaaattagcctggcatggtgacatctgcctatagtcccagctactcaagagactgaggtgacaggtatcctgttagtcctggagttcatggctgcaatgagctaggatcgtgtcacttccctccagactgggcaatacagcaagaccttgaatctaaaaaaattaagaaaacagaataaaggtcagagcaaaactaaacaaaagaggtttaaaaaatacaaactgtcaactaaaagttggttttttgaaaacattaagaaaaatcaatacactgacagccacactaatcaagaaaaaaaa

SEQ ID NO: 263836 - DNA, 242 bp, Homo sapiens
gaacctacccgggaggtggaggttgcagtgagccgagatcacacgcctgggtgacaagagggaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggcggtacgtaggctgcgggattgactttgaattc

SEQ ID NO: 263837 - DNA, 252 bp, Homo sapiens
gtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtt

SEQ ID NO: 263838 - DNA, 229 bp, Homo sapiens
cctccaggcgctcctagagctgtccctgggccagtggcttccaaagggggctggaggtggaggacggcagaagcggccaccgtggcacatggggtgaggactcagatgccaggaggatgtcctcatttttggaataactttgtttttttctctttctttttcagagatggggtatccctgtgttgcccaggctgatctcaaactcctgggctcaagtgatcctcccaaa

SEQ ID NO: 263839 - DNA, 462 bp, Homo sapiens
tcattagaagtgatgttaatttggattagcatcaggtaagaaagctagtgtctgccactgttaaattactattttcttttttgtaattaataaataatctgaatcttgtaaatatcctgtttcccattaaacttaatagttgtagcatcctggcaattctcacatgtattatttttgtaattagtgggacacaactaggttcctggagatgcagttgtttggcaaaagactgtatttctgagcagccagagtggatctagtcagatcagaaagaagccagcttatctgggtgacttaaaatttacactactttttcttgtcttaggctgtgacattcttctcccatgtggcccaggttgttctgtgatagaaccagggttgcaagtcataccctcacttagtcattcaacaaatatttactgagaagctactgtaacccaggcactgtttgaagagatacaa

SEQ ID NO: 263840 - DNA, 468 bp, Homo sapiens
gtatacatataaagctgccaactgtgatccacaaatgctggacgaaatcagaactagaactttagcccaggccactccctttttgcccaccttgcaacaaaatataaagaaacaataaacctgagaggtgctttaagaactttattttgggagttgctttggaagactattcagtcccatgtgcagttttggaaatacttattaatttacctctaagactcagagggccttattttgcagataaggaaggaaaatactgtctgattttaatactaggtgacgatggaaccaagcttcaacaaagctcagtcatatcagattaaagcaatcaaagaccagctaaaaaagtcaagtttttacatttctgacttttaagtagcattaaggaaaaattgattgtaatttttaaatatcatctgtttaagcgaaatcccctcataggagccaacaattgtttgtagattttgt

SEQ ID NO: 263841 - DNA, 356 bp, Homo sapiens
ttttttttgccttttttccacagttaatagttgttcttcaggaaggatggtctgtaggtggggtacattgctataattaaaagcaagacttctccgcactttttagttccatctttatttctgtatgattttactttcttctgtttctttcctgagtataatcagtttttgttttatttcttcctgttctttgtccatttctgtttttaaaatttttgatccatagtattttttaatatctccaaatgcttgtttaaggatatttaattctgtttcattgggttagtattttcttctcccttgtagttgttttcttgggcatgggagatggtggttattgtggttgtcagctcaaa

SEQ ID NO: 263842 - DNA, 293 bp, Homo sapiens
cttcacccatacccctcccctgatccatctgtacccacccactcctgttctctgcttgctcatcttgctttatccccagcacctcctgacattttctcatgccacccatcaccccattcttggatcagatgatgccgcctcctctaggaagccttactggcttgcagctctgtggtcctagagcattttggctgcccctgccagaggcctgacacctaaatgacaggtgaggtccttggcttagttctgtgagagcagtgacagcatctccactttccagaatcaggatgcgt

SEQ ID NO: 263843 - DNA, 489 bp, Homo sapiens
cccagagactgtgagattgctctttcagcccaagttcctactctctcagaactcctgatcagtcatttgttaatagcaacaataattactaggcatctacttaaacagcatttattggagtataatacatgtgcaaacaagaacacatatcattagggtgcaggttaatgaatttttacaaaatgagcatgcccatgtaactgtttcttctgatgatctagaaacagaatattgaggcacccacaaaaccacccttgtccctacaacccttgtccctttccagtgctcctttccacccttcccctttactgcctctaccaggggaaccactctcctgacttctgacaggtcagattagttttgaacttgatatcagtggaataatacaggatgcactcttctgaatctggcttctttcactcaacatgaagcttgtgagcttcatccagaaaaaataaaaaaataagattcctgactcaaaaaagctaa

SEQ ID NO: 263844 - DNA, 546 bp, Homo sapiens
catctcatattgtttccaaaagggaacagctctgagtggtctttgtcctttataggaaatcttttgcactagctattaataaaatttacttaggaaaaactttgaatactagtcactataagagcaaaatcaatctagttgttatgtacctattgttaaacagaatgtggaaatatgttagaacttaattgctttcatttttttttaaatgaaagtgtataagtggatattataatgtgtatatttgggttaataattaaactataatggaatttcagtttattagcactaggcgcagttccatattttgttgattttagactctggatgaatatacaatttgttttaaatatgaaagtacgattttctgtattattgaacacaaagaattggtttctaggtatctggtagacttggaacccgaggctttgtggagcagggtctctgcttccttcacatccataatggaccagcacgtggctattacaggagctgagaaatatttgaactgagtggcatgcatttgtctgggctacttaaaaaaat

SEQ ID NO: 263845 - DNA, 388 bp, Homo sapiens
gagtagctaggaccacaggcacacaacaccacacctggctaatactttttgtataaatgggatcttgctatggtgctcaggctagtcttgaactcctggactcaagtgatcctcctgcctcagcctcccaaagggctgagattacaaggtgtgacccaccacacctgagtgtctgtattttaagtaaaaattttttttatttttaacttttcttaaagacaaggtcacactatattgcccaggctgaactgccacctcagcctcctaagtagctgggaccacagggacacaccaccacacctggctgtttgtctgtatttttatgtatacatgtataaacatgtctgtttgcatattgtctgcagggtaccaaattgacctacaaata

SEQ ID NO: 263846 - DNA, 489 bp, Homo sapiens
ctacattacacattatgaaaatgttcaccatttccttactttgtctttccatggcaatatttattataatacaccagtggtgccgagtggagcaccttgtataattcatcacccagacacctctgctttagcaagtaaaaataacacagatgagcaacctgaaggactgtttggagtgcagcagcaattagaatagacacttaactctgggacattggtgtttttgtaccttgagaagtaccatccgtcactttcattcttggggaatacattctggctaaagaaaactcaagaaaattagcttttaacagttaaatctcttaaggacctttttttttctccaaatacgagcttgtactcttgcttatgcaaagtggaatgctctcagatcttgattctgccctgaattttcacgttctactcttacattctatttcaaccttaagtttaaagtaaaacaaaaacaaatgttctaaagcctaactttga

SEQ ID NO: 263847 - DNA, 538 bp, Homo sapiens
gtccggtgctgatgggtacttccagtattctcagcattcacaggagaacactctgagcaggcaaagtgaggccagtccatctgcttagaggattcgttttgccagctctcatgatcccctcgctgctggtaagcattctctacatcctgagtgggatctgtgccagctgccatctctcctgaactgccacacacttcagatcggaatgcagctgccgaaagaattttcacattcaccaaaggaagagtgggatttttttttttcaataaaatcacggttggaaggggtttaacactgcaagtgttgcttatacgaactgtcggttcgttcggtggatttccctcaaaccctgccccgtcccaccctccacttctgccccgtgcccacaccagcaaatacgaacagagaccgtgcctccagagtcctttgtttatatcataggaaaaccacagacttgggaacgcagcagctgggaggccattactttttgtctgagtcttctggagttctagcaaaataaaatccatgtgatggaaat

SEQ ID NO: 263848 - DNA, 395 bp, Homo sapiens
caacctccagagtagctgggattacaggcgcacaccacaacacctgcctaatttcttcgtatttttagtagagacatgaaatagtagtttgagaccaccatgttggccaagctggtctcaaactcctgatcacaagtgacctgcccaccttggcctgccaaagtgctgggattataggcatgagccactgcgcctggcctgcactacttttataatcaggaaaaaaaaaaatgctattttgagaaataagagaaacagcaagagaaatcctttttctagacaaactctgtaattagccgcaaatttaaccatatagaaaatatgttattctatacttcactggtttgtagaggcttcaggaggaggtttggcttggtgactaagatctctggcat

SEQ ID NO: 263849 - DNA, 439 bp, Homo sapiens
tgttgcctgaacaaaataaacactgaaaaatacaccaaagaacaccataatcaaattgctgctgaaaacaagagataaaaagaaattaaaaggcagacacagacattaaaatacattaggcgcaaaggaacaaatcataattagtgctgtcttctcactcaaaaaacaacgcaatttggtggaccagggagatgttaaaaaaataataaatgaagtagggataaatatagtaaaaataataataggaataacagcaaacttaaccactataaaaactatgccaaaataattttcagataaaagcttagagcatttattggggactcgcttgcactacaaaaaaaattaaaatagattcctaaggcaaaagagaaatgacaccaaatggaattattatctatacgcacacagatatcataagtagcaaacatgtatgtta

SEQ ID NO: 263850 - DNA, 423 bp, Homo sapiens
atgtcttgcccccaaaataccagtttttaaaattaatacgtgatattgtatccttgcaaaatatttgtaacatgtatgaaagttatgaacctctctaaaccaagagaccacatcaatctaaaagacagatgttatcaggttagggcctcttcctgtgtgctcctcatcttactgtgcaagctgggattcctggacaatggcaaattgaactgctcttcacagatatctttgacttgatattgatttaaaatgaactgcttgcttctaagtttccaccattaagaattatgtacattgttgtagatttctggtagttaacttttattcagttaaagaaattcctttcaagacctagtttactaacaattttggtcaagaatggatgttgaattataaaattgctttttctatgtctattatgag

SEQ ID NO: 263851 - DNA, 533 bp, Homo sapiens
  misc_feature (395)..(396): n is a, c, g, or t
aggtttagatcttaatcccagatgcactttgtccatgaatgcaaacgcaaactattggtcattgtatacacggaggaaatggtctttactggtgcaaatttttacagctgagatgacaagatgacccttgtcccatattgcagggtcatccaagattcttgttggtaggagtttcttttcatttcacacagccttgttcattaggggatgggggtggggatgctgcggtggtcagcgagtgaaacggggtgacattgttctctgtgtgtttgagggctataagaagagctgtgtgttgtgtgttcctatcacttgcagctgccccatagttgacctttgtgtccatctgctaacatgcctctctcccgaggctaatgctgaccagtttattcccnnatgcttgatgttccgcaaagtctcttgtatatggtgatgagaaggtatgcctcaccttccagggagtcacagctctagcaacattctgaagagaggaagggagagtgggagggaggcagggaggaaaggaaggaagg

SEQ ID NO: 263852 - DNA, 762 bp, Homo sapiens
aaaaaaagaaaaaggtagaaaattggaatatatttataataaataaggagattgaatcagttaaaaaaatttccaatgaagaaagactaaggaccatagctttgatggtgaatgttttcaaatatttaaagaagaattaacaccagtccttctcaaactctttcaaaaaaattgaagaggaggcaacacttcttaacttattctgtggggctagcattagccagcccaagaccctacaaaaatgaaactacaaaacaaacaacagctacagacaagtatctttaacgagtatgtaagaatcttcaaaatgctagcaaactgaattcagcaccagattaaaaggattctacaccgtaacctactatgatttatccaaggagtacaagggtggctcaacatacaaatatcaatcaatgtaatataccacattaagagaatgaaaggaaaaaaaaaccagtcatcttaattggtgtgcaaaagcatttggtgaaataagcagcctttcttgaaaaagcaaagcaaaacaaaaacctatcaaactaggaatagagtgatgcttcctcatcataataaagaccatatgtgacaaacccacagctgacatattcagtgataaaaggtggaaaactttttccttaagatcaagaataagacaagaatgcctgcttttggcaatcctgttttacattgtgctgaaagttctaaggagcaatttggcaagaaaaagaaataaaatgcttccaaattggaaaggaagaagta

SEQ ID NO: 263853 - DNA, 704 bp, Homo sapiens
aaaaaaagaaaaaggtagaaaattggaatatatttataataaataaggagattgaatcagttaaaaaaatttccaatgaagaaagactaaggaccatagctttgatggtgaatgttttcaaatatttaaagaagaattaacaccagtccttctcaaactctttcaaaaaaattgaagaggaggcaacacttcttaacttattctgtggggctagcattagccagcccaagaccctacaaaaatgaaactacaaaacaaacaacagctacagacaagtatctttaacgagtatgtaagaatcttcaaaatgctagcaaactgaattcagcaccagattaaaaggattctacaccgtaacctactatgatttatccaaggagtacaagggtggctcaacatacaaatatcaatcaatgtaatataccacattaagagaatgaaaggatcttgaaaaagcaaagcaaaacaaaaacctatcaaactaggaatagagtgatgcttcctcatcataataaagaccatatgtgacaaacccacagctgacatattcagtgataaaaggtggaaaactttttccttaagatcaagaataagacaagaatgcctgcttttggcaatcctgttttacattgtgctgaaagttctaaggagcaatttggcaagaaaaagaaataaaatgcttccaaattggaaaggaagaagta

SEQ ID NO: 263854 - DNA, 705 bp, Homo sapiens
tacccaatgtcatgatttggagctccagcagaaaatagtttaaagaatagtagtacagaaactaaaaaaaaaaaaaaagaatagactattaactgcattgagcacttgcctaattgccctcctggacagattaacctgcaagtgaaatgactgatttaattctgcctgtcctttctcacctaagaactcaatttggatggccaagttgctaactctgtttctaaacaacaggttaagtggcttaaaagttttagcacagttgtttcgttgtagttgcatttttgtttttgtgtttataactctttgggaaatacagtccaaggaaaattgttcctatagctatactcatatgttgccagacggtgtttggccagagttctaaatttaatctgtccctgcacctgatacgtaatgactgattttttaatgttctagacaggacccactatatgaagtatttcataatattagattgagatgctgtttcaggctgtcttcagataagagtgatctaatgattcatttttactgttttctaacacctgaattttttgtggctgtgtctcagccaattaggaggtaaatttagtgctctttgcttgaagcagttgcaagattatcgccccaggcgggttgtgaacattttgtcagtatagagaccttgaaacatcgaaaggttcaacatttcatttgtttacacccttg

SEQ ID NO: 263855 - DNA, 423 bp, Homo sapiens
taatcattgaaataaataaggcagtacttgtttattacccataaatagagtaaggatctatgataaataaatgatctagaagtccttaatgtagaattctgactaatgaatgaacataaaggaaaaggtggaattagtaagttgccttttggcaattataacagttgatttaagtaagaaccataaatggatcttaaaactaagtgggtaaaaatggatgttaaaactagtatgtgaaagtttgagagtagtagatgttaatatagtctcaaagtatgttctcataagttattgttaattttacagggggaaaataacaactttacagggggaaatctgacaccaacttgcccatgtgatgaaagtcaacatctttgatgttactctacataataataatgagcagagtttgttttactttgt

SEQ ID NO: 263856 - DNA, 403 bp, Homo sapiens
tctgtggcacaggtttgcaatttctatgctttcttgatgttgaaagcatcatagagttaaaatcaggctgcagctgttgcttgttagtaccataactttgccatatgttctaaggtttgtgaaatggagaataaatcccttggagctggagattttcaaactcttggatttcagtgtaaacataaggtattctacttttgaaagaactgtgaatgtctgaagcattttgacaaaatcatctttgatctcaggaagccagcatagtgcttagcacaaagtcaatgtgtaattgatgtatgatgagtgaggtttttctaactttttcaacaactgcccagtcctggaatgggtttaagattaacctgctttcctctcgttgcactaagtcaatcctttatttaaa

SEQ ID NO: 263857 - DNA, 619 bp, Homo sapiens
ggcagaggcacgcagatcacttgaggtcaggggttcgagaccaccctggccaacatggtgaaaccccatctctactaaaaatacaaaaattagctagacttggtggtgggagcctgtaatcccagctactcaggaggctgaggcatgagaatcacttgaacccaagaggcagaggttgcagtgagctgagatggcaccactacactctagcctgggtgacagagctagacgccatctcaaaaaaagaaaacaagaaaagcctgatcctggccagggaggtggccaggggaaatgacctttccactgagcccttcaggagttatagggggaaccgggtagagagtttcaggcagagggaagaagcaaggagaatcaatcgtcctgctcttcctccagctgttctggaatctagacagccctggtggctggaggggcacagagaaaggagcaagcctagggcgaagggtgatgttggggctggcaacatctgtgagcagagaagcagctgcctgaccttctcctgccccagggaaaccatgagtcctcaagtggcaggccagctgtcctctggaggaattctcctggcatctgtgggaaaagccaagacactttcaaaatt

SEQ ID NO: 263858 - DNA, 399 bp, Homo sapiens
ccaagcactcggagaggttctccgacgagcaccacttgtttgtataaactctgtagctgggaaatgggggacagttcagaactggagtgtcaaagccaagaggaatggagagcccacttcagacactagtcgtggtagacattgtgaagccaggaaagcgaagtgttgagaacactgcaggccatgcagactgcatcttgcctgcctaagatcacatggactgggcagaacttggacttgagcccagctcttctgaaacccagttgttgaatttccaccttagctcctatttctctggtgcttcgtcgcttcccaagtacatccacccaatcatcccacctaatcatcaaagtcacaaaaaccagcccaggatatgcacccacattcctaccttggttg

SEQ ID NO: 263859 - DNA, 166 bp, Homo sapiens
gcctattgttactgtcttcatcttacagataaggaattcaggcacagagaaagtaagtaatcttctgaaagtcacaaagctggagccagaattcaaacttagacttcaggccaggcgtggtggctcatgcctgtaatcccagcactttgggaggctgaggtgggcg

SEQ ID NO: 263860 - DNA, 1173 bp, Homo sapiens
atgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtgggtgtgatctccattcctttgtacatccctcacacgctgttcgaatgggattttggaaaggaaatctgtgtattttggctcactactgactatctgttatgtacagcatctgtatataacattgtcctcatcagctatgatcgatacctgtcagtctcaaatgctgtaagttatagaactcaacatactggggtcttgaagattgttactctgatggtggccgtttgggtgctggccttcttagtgaatgggccaatgattctagtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgctcagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaa

SEQ ID NO: 263861 - DNA, 551 bp, Homo sapiens
gagggaggttgggggagagaagagggttagggcaagggcctgagacagggcaggacatgcagggcaagcagccgagagcaaggtgtgtgcagcccggtggacgtgaggtgcccaggcttccttcccttcaggctgggtgcctgcccttctgtggccagcatggagtgggcagggcccttcaggccacccatgctgggggcactgagactttttgccaaaggtgacgtggtcatccatcatgcacagacgggctcctttccacagataggtaagggtagaaaacaagagccatcatcctttaccgtcaagaagctttggcatttcttttaggcaacaagacaaagttagagaaaaaggtgaacatatgtaagtcccaatggcagaggggaaaccatgcgtgagcaaagctttgagcaaaccaaagaccaggggccacactttcagaaaagcaatgtctcgggtcaccagtgctaggacgcaagaccacatcactctccgtgagctgctcacgtcatgccaacgactgtgcctgcactgccgtggtgaggcca

SEQ ID NO: 263862 - DNA, 359 bp, Homo sapiens
ttttaaatccctcaataaattctgggctccccatattggggtgaataaaagacacacttcctccagggctcagcatccacctgtgaaaatgcccccaggactgtcgagaacccagctgggaggccacttggatgattatccaagaagtaagggcgcagtactttggggcagcttcctgaaggtggtgggatttgatctccttcttacaaagtgggatttcagcaggtggtgtagggaagtttaaattttttccctgaaggtttgataatctgagtctatgaaacaaacataaaacattaacaggaaaaaaaaccgacttaaaaatgttactacgtgcacacatgtgcacaagtcataca

SEQ ID NO: 263863 - DNA, 680 bp, Homo sapiens
acatttcccactcagtgaaaagccttcagctgctgacagtctcatttgtatcatgtttcctatccatggcccttcctctcttgtcttgccaggttataatttgatggtgtcactgcagtgtgagttcgggtctaatctcagcgtggatggtgtcgtgcagaggccgggtggctcctttgttcctgggatccccattgcatcgctcagtgcccaggcttcttggtgacatcttgctggatgacttcagcctcctgcacactctcaggtgtgcccaggttgtctgtacttgaagacttcccagggagatgtcacaatgtccccagctgaaccctcggctgaacccagcatcatagagtgttcagccaaggcgatcagtccaggccttgaggcccaaagctgccccctgggtctcttttgccttcacctattgaaacgtatgttcagaatagctctttactcctttgggttctttagagttggctgactttaaacagcatatctatcagtttaaagatttagattttgggagcaaaggcgactcaatggagactggagagtcttttcaataaatggtgctggaacaactgaatatccaaatacacacatacacaaaagaatctagacacagcatttacaccttttacgaaaattaacttgaaatggatcacagacctaaatgt

SEQ ID NO: 263864 - DNA, 382 bp, Homo sapiens
acatggattttcttcaaatgtaagtacagtagttccccctcatccacattttcactttccatggtttaagctacctgaggtcaattacagtcttaaaataggggagtatagacacataagatatgttgagagagacagagacagcacattcacatagcttttattacagtacattgtaataataattttattctagtactcataatttttgtcaatctcttactgtgcctgatttataaattaaactttatcaggggtatgcatgtgtaggaaagcgcatagtatatgtagggtttggtgctccccaaggttcagtcatcccctgggggtcttggggctgctgtattcgaaaggaaaccaagacctagcaaagatacaataa

SEQ ID NO: 263865 - DNA, 1157 bp, Homo sapiens
taatcccaacaccttgagatgccaagatgggaggatcacttgagcccaggagtttgagaccaacccaggcaacatagcaagactccatctatcttttttttaaaaagagaaccacatccatattttgtggaaccacaaaagatctcaaatagcaaataacaaagctggaagcaccacactacaagtcttcaaaatagaatataaagctataataaccaaaatagcgtggttggcataagaacagacatacaacgtgagagaccctgttctaagtgctgggaatacagcagtgaacaaaccgaccaaaatttgtgccctcatagggcttagaatctagtgatcttaatcacaacattctgtttcccctcaaaatattctgctttaaaaatgtaaagccagatgcagtggcacgctcccatagcagggggctgaagcaggaagatcactccagcccaacagttcaaggttgccgtgcactgtgatcacaactatagacagccacttactccaagcagggcaaaacagcaagaccttgcttcaaagaaaaaaaaaaatggggattgtcaggcaacataggctgttatcttaaaacccatgaaagaaacttctgtctctctcgttcaatatctaactcctagttacaatccaacccctgacaactggacacagagaatgtgacgtctcctacagtaaatgggggactaagagttgtggggagaagtttttttacctttcagagacgatctgtgagtatataaggtgaggggaagggaaaatctgggggggaaataggtacagataaatccaaaaggaggctgttccaggtaaagctgatttacttaggggtaacctcaacgccttcattttgatttaattttgactttgagccaactgaaatgtgacactgtgtactgggatttttaaaaacatcccctttataaatagaaatacctggagaagaagaaataattcttcctatattgtcttttcctatattttaatagtagatggcctgcagaaatcatatcagggcgaggtgcagtggctcatgcctgtaatcccagcactttgggaggccagagtgggtggatcatttgaggccaagaattcgagaccagcctgagcaacatggcgagaacccatctcaacacaaatta

SEQ ID NO: 263866 - DNA, 2237 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263867 - DNA, 1172 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttc

SEQ ID NO: 263868 - DNA, 912 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctccatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaataatgcatggcttgattggtaagcttggtcgtctaaccgtcgtagggcgggataagtaaccatctgggggaatcgct

SEQ ID NO: 263869 - DNA, 956 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagatgcccatgctttggagcaaggagtggcacagggaggtttgaagtcaaccagggcaaccattttgacacctcacatggcaagtttggcctcgaaatctggtcccaaattaagaagggaaactcagccccttcctggggtcattttgggcacccccaggctcgtagca

SEQ ID NO: 263870 - DNA, 966 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaccgggtctcatttatggagggagccagcttgagagggggcatggggttgggtccaccgggcactcggaaactatggaagttggcgaaaggcccgaaaaagggggccacaccccgaggggaaactgcgggccacccttgtggcattttttgaaaaaaaaagc

SEQ ID NO: 263871 - DNA, 839 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaatcttttcagtggatccaaatggaaaagaagtaagctctttatcttcccttatgatcgcaaatcaaacatgagggtaaattggtgactctgcttaagtggtgatctagtcatcagagtccaaactcccagatcctcatgagggcttatctccgactctttcgtgggatttcaacgttaaactggggctgctgcaccagcaggagcagctatggcggcatcaagccacacaggggcaccaaccacaaaggcagatggattcagactagaaggtcttgacgttttcagcaagtgggaaggtgtaatacg

SEQ ID NO: 263872 - DNA, 2281 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263873 - DNA, 1135 bp, Homo sapiens
  misc_feature (1103)..(1103): n is a, c, g, or t
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttcnttaaacccttcctgaagggtgtttccactaga

SEQ ID NO: 263874 - DNA, 2310 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263875 - DNA, 2354 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263876 - DNA, 2282 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263877 - DNA, 2133 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263878 - DNA, 2089 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctccatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263879 - DNA, 2326 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263880 - DNA, 2355 bp, Homo sapiens
atgtccaatgggaaagcagctcggtgtcacgcacctcctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagcgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatataaaactctttaaaacatactaattttttaaagcttatatgcttatttcgcttccccagttgttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgtgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgtttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 263881 - DNA, 475 bp, Homo sapiens
  misc_feature (324)..(324): n is a, c, g, or t
ggggcccgtcactgtgcatttaggcttcttgctcttctttacaagcctgtttcctttcgctgtctccatagcacccttacctaaaggacttagtatgttttcaatcccagagcattctgcagtgtgttgagtgaatagtttgtccctaaagcaagagttcttaaaatcaaaatcgttattttcatttttaatcaaactaatatatgtacataggtttagattgtttttgttttttgttttgttttttgagatcgagtctcgctctgcactccatcctgggcaacagagccagactctgtctcaaaaaaaaaaaaaggcagtgcntcacacctataatcccagtactttgggagtctgaggtgggaggatcacttgagcctacgaagtttgaggctgcagtgaaccatgatcttaccagcctgcactctagcctgggtgacagtgagaccctgtctcaatttttaaaaaaaaaaaa

SEQ ID NO: 263882 - DNA, 704 bp, Homo sapiens
caaattcatagattttgaatcagtactttcttttattggatatatttgtacagcacaaaagaagtttgctattatgccatgaatctattcatttgaatcaattgtctttaaaacatttttattgctcatctcatctgtaaaaacttttacacaggcacattatacatttatttatttaatgatatacatgttctgtgcattactatgtatatagatttcagtagaacaaatttaagaagaatgagacaaagattaaatgaatactttaaagtttgaagtgtaatattggcatgagaaactttttgttcatgttaaaattgtaacatactatgtttagttttaaaaatcttgaattagtcctctgctctgaagatgtagctagtacagtttattttaatacttgattttaatgacggtcacagttgaaaaattatgtgtcaaagatgtgtagatccaaatagaaatggtcagctatgattacaaattcacatcactcacatttcaatccatctaccaattatgaggcatcatttgttgaaatgtagctagcaaatttctgccttccctaatgtcaattgcatgtttctgcaagttaatcagaggattttttttaacaaaggatgtcaaaaatccattcaaactcttcatttggaacatttttttaaatgggttaaaattttcttagttgtcatgtttcattagga

SEQ ID NO: 263883 - DNA, 221 bp, Homo sapiens
cccaggcacaccctaacttacccttggagcttacaggaattccaagaaaatccacatgggtagagattgagcgtctttcccaatgggcagtcaagatgatgagatggatcactaaattctaaagaatccatgtcatgctgtatacacacagcaaggagggccttaatattagcaaaacaacatcaagtgtctcacattaaataaatgttgttaactttaag

SEQ ID NO: 263884 - DNA, 122 bp, Homo sapiens
gtaagtggctttgcatattagaacccaaatattttgctctctaaatctaatgctcgctctatgtggttatgtacatattgacaaatattcatttattcaacaaataaaaagtatgtacaaaa

SEQ ID NO: 263885 - DNA, 444 bp, Homo sapiens
gatcttgatggacttaaagattcattaaatggaagactttacagaagtatacagaaactagttaaatatagaagattcttatagagatatttagaaaatgtagttagggtgtgtaaacaaagtaatggtccctggtagatttaaatcaggaataccagtttttatgcttcttgccacagctgtaatggagtataatatgatatattcttagtgtaatttgataaaattagacattttccaacatatgcgaaaatattttctgtaggaacttgaggacttatcattatgttagaattttgttttgagactagatcctagggcagttttaaagtgactaccagaatcttaaagacatgtgatggaaaaatagatgggaggacagttaatggagcagggagaattaatacggaaataataaggtaacttagagggagagaaaaggaa

SEQ ID NO: 263886 - DNA, 431 bp, Homo sapiens
gtatattcctaagtattttaatttttctttggcagctgttgtaaaagggattgcgttcttgatttgattctcggcttggtcatcattggtgtatagcagtgctactgatttgtgtacattaattttgtatcctgaaacttcactgaattcatttatcagatctaggagcttttcaaatgaatcttgagggttttctaggtataagtttgtatcatcagcaaacagcaacagtttgacttcctcctttgcagcttggtataaaattctttaaattttgctgtatctaaaagttttcaaaataaaatgttactgactaaaaatatattcttaggactgtactttcagggatcatttctatagtttgtttctagagaagtttctctgaatatgtagagcactggaaaaatcaatattttttttaaaaaagagaa

SEQ ID NO: 263887 - DNA, 367 bp, Homo sapiens
gtttaatccattgtaacatcatatgggttccttcattaattagtgagttaagtgaaatttttgacatgttcattttatattcataaaaaagtcataacttacctttaaaaaataattacagtgagctatgaccatgctactgcactccagcgttggcaacagaatgagaccctgtcttaagatactcagccaacattcacatcatatcaggattgaacgagctgaacagactgtctactccttcattatttgtgtattaacagatgccaaaaatcacctctgcaagatgggttcaagagacaacacaggcttttgatttagagatctgactcacttttatcaagagtgttcatgaaatcaaggatac

SEQ ID NO: 263888 - DNA, 1750 bp, Homo sapiens
gggggtggatttccttcaggtagtatacattctttttcaaatggaagagctggttatagccaacaacatcagcattgacatagtggacatgaaagagaagaggaaagaggagatggaggtttttctgtgtttatccagctgatgcccataattgtattgatcctcgtgtcattattaagccagttgatggtctgtaatcctccttattccttctatcccagatctggaacagggcaaactattaaaacgcagacagaaaacttgggtggtgtttattatgtcagcaaggactttaaaaatgaatataaaggaatgttattacaaaaggcagaaaagagtgtggaggaagattatgtgactaatattcgaaataactgctggaaagaaagacaacaaaaaacagatatgcagtatgcagcaaaagtataccgtggtgatcgactccgaaggaagtcagatgccttgagcatggacaactgtaaagaattagagcggcttaccggtctttataaaggaggatgaactggaatttttatttataccttttagcgtactctttattttttctgtaagtaagtttagtttcatcatgagagatgaaggggaaagatctgatactgaaaattaaactgaatagttggttcctgaaatcttggactgtttatgacctactggctcctttaataggtaactgaaaactaaaatggaatatttaagttacgcttctacaattattttcattttaaaagcttgcatgattcctaactaaaatgtcttgagaaaggattatcacacctgtagcaatttccagttttagtgattctccattttttcccttgtcatgtaaagatttatggaatgatcactttgtgtacatacaggttactgcttttttatttaaattcttttagtgttttgctccgtgagacacttcagtttaaattgatggaataaatgttatatgacacatttacgttttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactgatgtagaatatcattttgctatttagttttatgaattactatacatatacatgcatagaaatgaaatgctatactgatagattttaaagaaaatatgaggaaatggctataaatagtaaactaaaagggtcttcaacagtaaagtgcagttatgtcatttacaattccaatactttaaaggccaccaaattttgatgtgtatgtccttgaagggctgccaaaatttatgaagaggactcacattttcccccatagaaatttgcagtttcttggtgatcatttaagcaggatccaaagaagttcttctacaaataagtaataagaaaaatgaatactaaaatacagctttgtgccttttaaccttatgccaactcctaaacatgtaagtagattatagtatacttatctgatcagagcatgatctgtttggccacatgcaagtgtgagcagaaatagagcagcaggtagaatagtaacttaaagcaagtcctcctttaaaaatactgagctaaaatctattcaccattgagtaattgaattaatcctataggaataagctccttgtaagtaattccatattatgaattagaaaaaaaaaacag

SEQ ID NO: 263889 - DNA, 634 bp, Homo sapiens
agaaaaggacaaagtataggtggagtttctcttttttgccagttgttattacttaattacactatctttctggccataaaatgaacaaaaggattcattcacttgtctcgttaggtattaagcatcagttgtcgattcattcatttcacacatttcactagtgacactgaatactgcagagcctaagatgaaaggggaagcaattcacaggccgatgagaagatgcacgattgccattcaggtactgagggctgcaacagaggaagggtggtgagagcactaatgaattcttgctattttctgatcattgtctcatcctaataacagctccctggaaaaggtactattaatccctaaagaaactaaaattcagaaagattaaatgactttccctcacaattattttctatctgctacaccaagtggcatccttgagttttgcaagatgccctcagtgccaaggcatgagtccttaccagggaaactttctttctttctttcttttttttttttttgatggagtctcactctatagcccaaggtggagtgctgtggtgcaatcttggctcactgcaacctctgcctaccaggctcaagtaattctcctgcctcagcctctggagcagctggaatt

SEQ ID NO: 263890 - DNA, 495 bp, Homo sapiens
atgggtttagagtttaacgatttttcttaatctccatccagcctctggtgttgctaaataaagcttttcaaagacaggcttcctaagaaaaaaggtcctggggcacaatggaatccagtaagaaaaagttttggcttccagtgtcgcttccactacctaccttaagagtgtcagaaacttcaggaatcccactctgcttctttaagtctgaaacttcagttctcatatttatcagttaaaaagggtgttggtctagctaatatttaaggacagacccttccagttttaacactacataattctaagatgagtgatatccacaaactacataatcagacaccaggtgagagaaagttaacttaataaatatcaaattgaacattattacggctacttgaggtatgcttttctgacacactgaagttctttttcagggcaatccgatctgatagatgaaacccagaaggaaaacggtaaagaatataggtttactga

SEQ ID NO: 263891 - DNA, 344 bp, Homo sapiens
gccttcttagtagctgggattacaggcgcaagccaccgcacccagctgatatttgtaacttttttcatctactgcctatcccatgtgtcctttgccctaagccaggaccacatctagtcagggttctttccctggtaggatgtcctaagtcttcattcttgatgggtctgaatccctagtagtcctctttttttttttttggtagctacatagatatcgataaagaatcaaacaaaagaaaatagacttcagttaaagcaggaggcattggattaaacataagaaacaactatgggccagggccaccccctgcatcttggcctaaactcctctcaacccccaaa

SEQ ID NO: 263892 - DNA, 464 bp, Homo sapiens
agagttagagagagagagagagagagagagagagagagagagagagagagagagagagagagagagagagagagagagagagatcacaatatgtttattgattcactgttgatggacattaaggggtgttaccacttttggtgatcatgaataaagctgctataatgttcacatatggtctgtagtgtggatatatgtttttgcttttcttaagtaggtacctgacagtgggattgctaaattattggttagagtactttaacatttatatttaattgccaaacttttccaaagtgactatcccattttgcattcccaccagcagtttctccacattcttaccattcctaccaacctattctttccaaagtcttgtgaatgttctttttttccttccttcttacctgcctttggtccttctttctttttgttaaatttcattcattttacttggtgttcagtgg

SEQ ID NO: 263893 - DNA, 2104 bp, Homo sapiens
  misc_feature (883)..(883): n is a, c, g, or t
  misc_feature (889)..(889): n is a, c, g, or t
  misc_feature (1155)..(1155): n is a, c, g, or t
atatcataggtgtcaggtacccctgaaagtcttcataatgaacagtgagaactctcctactgggcttctggaatgttgggaccactctggtccaatgctactgtcgtttcctgtctggaaatgagagtagcttcttgaatattcttcctattcctactttggcttcttttaatctattcacaccattccatcagaaccacctgagggttttgtccaaaacacagctccgatcctgtcacgacctcttgctttaaagcccattagtagctttctgttgctcttgtgatagaaacaaaactccctgatacagcctacatggtcctgcattgtctggctcccacttccctttttcatttcttaccacactccttggcctctgcactagaggctcactggctgattgcaggcttgagaactgaccatgtttgtttctgccagaggcctttgcactgctgttttcttttcctggaatgtgcttccttccctatttagttaactcctagtcatcctttaatttattatttgagacggtcttgatctgtcacccaggctggagagcagtggcacgatcttgcctcactgcagcctcggcttcctgggctcaactgatcatcctcccacctcagcctcccaaagtgctgagattacaggcatgagccaccgtgcccggccagctcagtgaattttgtaaagcaatcatgttcatgtagctaccactcaattaaaaaagtactggccaggtgtggtgattcacatttgtaatccaagcactttgggaagctgaggcaggaggatcacttgaggccaggagtttgagaacagcctgggcaagatccttgtttccacaaaaaatttttaaaaaacccatctgagcttggtggtntggacntgtggtcacagctactcaagaggcgttcttagcccaggagttcaagattacagtgagtgatcattgtactccagcctgggggacaaaagtgagaccctgtcttaaaaaacaaaaattaagataatacctaccagcaaaaaccagagggaagaatacttttaaaattagaggccgggtgcggtggctcacccctgtaatcccagcaccttgggaggcctaggtgggcagatcacctgaggtcaggtgttcaagaccaggctggtcancatggtgaaaccctgtctctactaaaaatacacaaattagctgggtgtggtggcaggcgcctgtaatcccagctactcgggaagctgaggcagaagaatctcttgaacccgggaagcggaggttgtagtgaaccaagattatgccattgcactccagcctgggcgacagagtgagactttgtctaaaaagaatataaataatattagacagttgtcttatggagatacaatttacattttaaaaaaactcatagttttttttttttttaggcagtcttgctctgtcacccaggctggaatgcagtggcgtgatctcggctcattgcaagctccacctcccgggttcacgccattctcctgcctcaacctcccaagtagctgggactacaggcatcccccaccacgcctggctaatttttttttgtatttttagtagagatggggtttcaccatgttagccaggatggtcttgatctcctgaccttgtgatctgcccacatcggcctcccaaagtgctgggattacaggcgtgagccaccacgcccggcaaacccatacattttaagtgtatacacagacaattccactctctgatcaaggtatacaacattactcttacctcaaagttcccttgttgccagtcaactctgcccttccctccagagtcagagcactattttgatttttttgtaatttagttttcctgaatctagaacttaaggaaacatacagtagatgtgtgtgggggcatgatcttaatataaaatactagatggaagactggaaatacagatcagactattataacaaaataacttggacattatattcctttaaaaaaactttgcccccaatccctaaagaatgttggttcttaaggaagctgaggcaggaggatcacttgaggccaggagtttgagaacagcctgggcaagatccttgtttccac

SEQ ID NO: 263894 - DNA, 585 bp, Homo sapiens
atatcataggtgtcaggtacccctgaaagtcttcataatgaacagtgagaactctcctactgggcttctggaatgttgggaccactctggtccaatgctactgtcgtttcctgtctggaaatgagagtagcttcttgaatattcttcctattcctactttggcttcttttaatctattcacaccattccatcagaaccacctgagggttttgtccaaaacacagctccgatcctgtcacgacctcttgctttaaagcccattagtagctttctgttgctcttgtgatagaaacaaaactccctgatacagcctacatggtcctgcattgtctggctcccacttccctttttcatttcttaccacactccttggcctctgcactagaggctcactggctgattgcaggcttgagaactgaccatgtttgtttctgccagaggcctttgcactgctgttttcttttcctggaatgtgcttccttccctatttagttaactcctagtcatcctttaatttattatttgagacggtcttgatctgtcacccactgcatttcagtctggaggacagagtgagaccctgtg

SEQ ID NO: 263895 - DNA, 2282 bp, Homo sapiens
  misc_feature (883)..(883): n is a, c, g, or t
  misc_feature (889)..(889): n is a, c, g, or t
  misc_feature (1155)..(1155): n is a, c, g, or t
atatcataggtgtcaggtacccctgaaagtcttcataatgaacagtgagaactctcctactgggcttctggaatgttgggaccactctggtccaatgctactgtcgtttcctgtctggaaatgagagtagcttcttgaatattcttcctattcctactttggcttcttttaatctattcacaccattccatcagaaccacctgagggttttgtccaaaacacagctccgatcctgtcacgacctcttgctttaaagcccattagtagctttctgttgctcttgtgatagaaacaaaactccctgatacagcctacatggtcctgcattgtctggctcccacttccctttttcatttcttaccacactccttggcctctgcactagaggctcactggctgattgcaggcttgagaactgaccatgtttgtttctgccagaggcctttgcactgctgttttcttttcctggaatgtgcttccttccctatttagttaactcctagtcatcctttaatttattatttgagacggtcttgatctgtcacccaggctggagagcagtggcacgatcttgcctcactgcagcctcggcttcctgggctcaactgatcatcctcccacctcagcctcccaaagtgctgagattacaggcatgagccaccgtgcccggccagctcagtgaattttgtaaagcaatcatgttcatgtagctaccactcaattaaaaaagtactggccaggtgtggtgattcacatttgtaatccaagcactttgggaagctgaggcaggaggatcacttgaggccaggagtttgagaacagcctgggcaagatccttgtttccacaaaaaatttttaaaaaacccatctgagcttggtggtntggacntgtggtcacagctactcaagaggcgttcttagcccaggagttcaagattacagtgagtgatcattgtactccagcctgggggacaaaagtgagaccctgtcttaaaaaacaaaaattaagataatacctaccagcaaaaaccagagggaagaatacttttaaaattagaggccgggtgcggtggctcacccctgtaatcccagcaccttgggaggcctaggtgggcagatcacctgaggtcaggtgttcaagaccaggctggtcancatggtgaaaccctgtctctactaaaaatacacaaattagctgggtgtggtggcaggcgcctgtaatcccagctactcgggaagctgaggcagaagaatctcttgaacccgggaagcggaggttgtagtgaaccaagattatgccattgcactccagcctgggcgacagagtgagactttgtctaaaaagaatataaataatattagacagttgtcttatggagatacaatttacattttaaaaaaactcatagttttttttttttttaggcagtcttgctctgtcacccaggctggaatgcagtggcgtgatctcggctcattgcaagctccacctcccgggttcacgccattctcctgcctcaacctcccaagtagctgggactacaggcatcccccaccacgcctggctaatttttttttgtatttttagtagagatggggtttcaccatgttagccaggatggtcttgatctcctgaccttgtgatctgcccacatcggcctcccaaagtgctgggattacaggcgtgagccaccacgcccggcaaacccatacattttaagtgtatacacagacaattccactctctgatcaaggtatacaacattactcttacctcaaagttcccttgttgccagtcaactctgcccttccctccagagtcagagcactattttgatttttttgtaatttagttttcctgaatctagaacttaaggaaacatacagtagatgtgtgtgggggcatgatcttaatataaaatactagatggaagactggaaatacagatcagactattataacaaaataacttggacattatattcctttaaaaaaactttgcccccaatccctaaagaatgttggttcttaaggaagcagtgtttgttctatcagaatcctattatcactccttggacttagttggtaaagtaacagaccttatgaaaaggaacagtcgattgctctgtggatgtggccccatgtatcccactttgatttcccttaaacttttttctcaccacaggaaagtaaaacaggattcaaccccaggaggcagaggtgcagtgagctgagatcacgccaactgcactccagcctgggtgacagagggagactgtct

SEQ ID NO: 263896 - DNA, 427 bp, Homo sapiens
cccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaa

SEQ ID NO: 263897 - DNA, 430 bp, Homo sapiens
acaggtctcactgtgttgtccaggctggagtacagtgacgtgatctcaactcactgcaacctccgcctcccaggttcaagtgagtctcctgcctcagcctcccaagtagctgggattacaggtgcccgccaccacgactggctaatttttgtatttttagtagagacagggtttcaccatgttggcccaggctggtctcaaattcctgaactcaagtgatccgcccgtctcagcctctcaaaatgctgggattacaggcttgagccaccgcgttcggccataattatccttttttaaaaaagtaattttgttttgttgagcccagatctttctctatcacccaggctggagtgcagtggcatgatcacggctcactgcagcctcaatcttcccagctcgtcgacgcggccgcaatttagtaatagtaggc

SEQ ID NO: 263898 - DNA, 613 bp, Homo sapiens
cagattcagagtggggaagagtaactaaatatgaatttagagctgagcaggggccaggtcttatatggttctgtttatcatagtaagaaatttggatttttcttttccaagagtgattgaaagccataatcaaaaatatgtttttaaatgatcactgtagatgctctgtgaagaatatactaaacaggggcaagattggaagtaggaagatcagttatcaggctatttcagaagtctagattagcagtgaaggtagcttggattgggatggtagtggtgaggggtggtaagaagatgctgtattcatcttatgatttgaaagtagagctaacagacatgccatggggtatgagtcaccacgaatcctagcggccaccccgctcgtgttctaatttgccgctcttctccaggcaaaatccttggttgagggaactccgccctattacgctatatattcaaatccccctgtcctcaaattccctttctacacccacgtcgctgggtttccaactgggtgtccccccatcttcccggctgtcccccttggcctctccccccccactgcccttctaatcttttccaccccccccctcacttttccccccccttcccc

SEQ ID NO: 263899 - DNA, 857 bp, Homo sapiens
gacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaagtgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttataatggtggaaaattagaagtgattgtgaaaatgatgtctacccgccttgctgatgagtaggatgtgatttggctctttaggaaactgaatttgcagaactgaagaatattgatttataaagggcatggccattgacccagtccatcttatgcaaatctggatgccataaataatatttaaaaatgaaagtattggggtggaggttgcagtgagcggagatcgccccactacactccagcctggtcaacagaaacaaaaaaaacaaaaaaaaaaaaaaaaaaaaaaagaagaagtc

SEQ ID NO: 263900 - DNA, 425 bp, Homo sapiens
gtgcaccttacgtgtattgatttttgtctctgcctgtaatttctctccttctaaaatatgtaaaatcaagctgtaacccaaccgcctcgggcacctgttctcaggacctcctgagactgtgcctttggccatggtcactcatagttggctcagaataaatcccttcacatattttacacagtttgactcttttttattgccaagcctctgtttataggttgatacttgtcccatgcctcctgccctcacctgacaatcactgctgccctctgccctggggcctgggttcaggggcagggaagtcagagttgggatcaggtgcctggcatgttgaattgcacagcagggtcctgagttcctgtctgcatctgtcctcaccctgtaagcatccatgtccaagggagagtgacatcaaatagcaaatt

SEQ ID NO: 263901 - DNA, 445 bp, Homo sapiens
ttctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcaga

SEQ ID NO: 263902 - DNA, 436 bp, Homo sapiens
tcatacctccttccttccttcctctctgccttccttccttccttccttccttccttccctccctccctcccttccttccctccctccctccctccttccctccctctcttccttcctttcttgctttcttccttccatccatcattcctttgctttctaacttcttcccttcgccctccttgctttctacttatgactttatgaatgcaaaagtatttgtagaagaactaaacatttattacaggataaataatatgcagctaactaaaatgaacccaaacatataatgacacatttaaaataatatgcaggcctaatggcaagttatatttaatagaaccaaccattatataacatgtaaatattatctatataagatccatcaatatcttgggatgagtatttcagcctattttaatatatatttttctttgta

SEQ ID NO: 263903 - DNA, 911 bp, Homo sapiens
ggaaatgtgggagtgagcaatataggtatgggaagagcattctaggtagaggattaggaagagcaaaagccctgaagcaggactgtgtctggcctctgaagaaatgcaaattgttcagggttgttggacctgaaggaagaggaggaaaggaataatgaggccagaggggccagatcatgtagggatttgtaggttgttgtaaggattttggttttcactaaatgaatggtgaaccatttcagttttgagcagaggagttccatgatctgatttgaattttaaaagatgtgtttcccaaaattcctattcctttcatacagctgctttcaatgaaggtttataaggaaagcaatcagaactacttggataaggtataagtgatccacaatcttttcaactctaccataggtatctacatatatatgttgagagatgctgctttttggccaaaatgaatcttgaattgggggtgtgcagaaaaagttatatctggcctgaggctggtatcttttagagtggcctacttgcatggttggcccttatctgaacacgtggatttaggggtattctcactgttcactaataaaggtggttcactgtacctagactgttcaaacaagatgatttatgctaaacacctgctttccttctgggagtatggaattttggtacatgccaggtaaaggatgtctatatgaccaaactcccaatgaaaaccttgcatactgagtccctaggcagaaacatccctcgtataaaaatgtgctctgtgtgaatcttcatgggagggagagatcctaaagaagcctgcacatggattcctccagattctgcttatgtctttttcctgtatgatccaactgtgtacacttactgtgtcactgtaataaactttagccatgagtacgata

SEQ ID NO: 263904 - DNA, 339 bp, Homo sapiens
gaagagctttctcatgaatatttgttcagcatcattctcaaaatgttttatatattgttcatatttacagaagtatattgatcgcccagttaaattatcttgcaaacaaccaaaaatgtcacgtaagcccagaattttttcacacattctagaatcagaaagctttttttctggcacaatcttcttgtttatcctcttattttatatgttccttccactatttaaggttgtcttataggttttctatgtatttacttgtatatattcctgtctttctgtgacttctggttgatatgtgaaggcccttaataataaattcaactttgttttttaaactgg

SEQ ID NO: 263905 - DNA, 425 bp, Homo sapiens
caagtcttttgtaagtctaaaattattttaaaataaaaagttttttaaaggtctctgtgaagtggctagctcccagtaggcacttaatgaatgagaggtattataatgataagcaaagacattgcttccaatagtgttagtaatcaaagaaatgcttcttggtggaaaagacagagccattagttggcaatgctgtgcagcagaaaccattccagccacagatattacatgaccgtgggtgaaatatgttataaaaactagttctttatccttgaaggggcttctgggaattgaaatgtgcagttgtttatgtgttcattatctgccctttgttcatgggctcgagttggacttctccctgatagcattggtttccacagctgtgccattgaataaaccttgagtttggacctgttaaaaaagaa

SEQ ID NO: 263906 - DNA, 439 bp, Homo sapiens
ctgcttcagcttaacattattttcaaaccaacaaacatgtcccgcaaacacatatatttaaatgacatgacatctgtgtgggctggagtgtttttcccgcctcagcggcagccatactactacaccagtccagatctgtttgcagagctgccgtgttgtgcagtccagaggtgctgctgctgttgtattctgcatggaggtagtcaacaagacagccctgcttaattatgaaatgtctgtagcaccctgtgtacgaaggtgtatagaagtgtatagaaagcacccaaaagagcagcagcttggctgggcctggtggctcacacctgtaatctcagcactttgggaggccaaggtgggcggatcacttgaggtggacggatcacctgaggtcaggagttcgagaccagcctggccaacatggtgaaaccccgtctctact

SEQ ID NO: 263907 - DNA, 668 bp, Homo sapiens
tgaagacccgaaaagggtgagcagacaccattcatgaccccaaacagcaagaggacagaagtctgcaggatgctcagcaggggcactccctgaacacgcctgctcccacagcatgtgcaaaggcttcacacttggattgagggttatacatttcttcatggacatccccaaacaacacagaacagagacaaggtttctggtccttttggaatgtccacaccattcccattcttcaaaatctgtcacacttccagatagttccagtgaacaatgaactctccccctatgcagtaacagttgattattcaatttaacactgaattatatattctctggaactgttctctaacaactatgaggcgttttcaacggtagttaaatggaaaaataccaaactgggagtaaaaagatctggcttccaggccaggcgcggtggctcatgcatgtaatcccagtactttgggaggctgaggcgggcggatcacctgagctcaagagttcgagactctgtcttaaaaagatagatagatagatagatgatagatagatagatagatagatagatagatagatagatagatagatactcatattattttattgtttaatgaagcagaagtcatttaagtcttgaaaaaaaacgacaacaaatgagcggccgcaagctt

SEQ ID NO: 263908 - DNA, 400 bp, Homo sapiens
cttgatctgggagctggttatacggtgcggtcaatttgtggatatttatctggtttatctacttttttttgcatgtatatttcaataaaatatttttaaaaaacattcctctcctgatgacttagtggagaaaatctcagcttgggtttgacttaacttgaatgcttcttctaaattgtctcatctttcttaacttgggaagagtgtgccagcttcagaagcttcagcaggcaacagtatccagctcgaatcaaataacattgtcttgttttcattgtgttttatggttaccatctatagatggccatcaatactacatttccatttatggtagtgatatacaatttcttttaaaaatgatcgtaagcaaaaaaaaaaaagagtgaattgccttacttta

SEQ ID NO: 263909 - DNA, 397 bp, Homo sapiens
tcaaagtgaaaagaaactcccagtgagttatatagtgcacagtgcctgtaagatgaaaaccagcaatagctccagagtccaagtcctcttacaactaagactgaaagcacgtctccccaagcattgcatcaggacagacccagtaccgtggaaggagcactgcccatggaacagggcgggggctggccacactgttccttctccttctctgcagcacatgcctcacactcactccaaacccaggtctaggcagagcaggcatggggcaagagtggccagggcaatggccaatggcccagggcaccagccagagctgggttcagtttcacgtcttcaaagcaaatatagccatgagtgtttgttgagcaaaatggttctattatgaaggctgctgacc

SEQ ID NO: 263910 - DNA, 311 bp, Homo sapiens
cttgccagggagaagtcataccgatgggcgatacccatactgactgctgctatacccagcagtccctggtcgcccccagaactcccatcctctgaccctgtgctgccttgcagcccctcagccccccatgcatgccccccatgcatgcccccaccatccctgcagtgagaccccgcagcctcctgagatgccaggtaagccatgcacagccaggtgctgtgcctcagaacttgctgcaaagctacttatgcaaggcgggggaagccgtcctgggaggctgtgcaggtgagcagccaataaacaagtgaaaa

SEQ ID NO: 263911 - DNA, 595 bp, Homo sapiens
atattttacatgagtaattcaaatattacatgagtaattaaagaagtacaacttattgcaaccctgagggccattgctaataaatcgagacaagtttttttaaatggtagaatccagttctataaagggagtgtttttatatgttttgattagttattttacttggtaaaactcttttagaaagtaattaggcgatgtatgatgactctttaaaatatactaatatgccctagtattaatacttctcacaatgtatcctaatgagataatctcagatatggaaaaaatattttatgcacgagcatgttcatctcaatatatttgtaatacttaaaatttaaaacagcatgaattcaggtaagatgttaaagcaaattatgataacatatttgtacttgatggcctattactgaaatgatgcttgccaagaatttaagataacacatggaaacgtttttgttatgatgcatgtaaacaaggcagtctatgaaatgaatgcatgtacaatataaaattatgtagagcctccctttgtatctgtctgagctaaaaaaattatgcagagcaaaatcatgagataaaaaaatcagaaaag

SEQ ID NO: 263912 - DNA, 444 bp, Homo sapiens
atttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtct

SEQ ID NO: 263913 - DNA, 478 bp, Homo sapiens
actccctatgtggtttgctttgtgtttctattggacaaagttggtctagacagtacaaggtgtgaagacaccgccctctgctggagaagatgctggatttttatttcacctacaggaagagacgtctaagtagcaattagatgctaaactaatgctgcctcaggaaagaatcaaaagagaaagagtgaaaccaggccgggcgcggtggctcacgcctataatctcagcactttgggaggccaaggcgaggggatcacgaggtcaggagatcgagaccttcctggctaaccccgtctctattaaaactacaaaaaattagccgggcatggtggcacgtgcctgtaattccagctagtcgggaggctgaggcaggagaatagcttaaacccaggtggcggagggtgcagtgagctgagatgtgccacagcactccagcctgggcaacagagccagactctatctcaaaataaggaaaaat

SEQ ID NO: 263914 - DNA, 289 bp, Homo sapiens
ctctggttacccttgctgctcattatatgctaattataacacactagcaggcaaaaaggcactcccaccagtgccatgagggtttacaaatgccatggcaacctggcaccccaatccccacccccaataaattacccggaaaactcatgaataatccacactttgtttagcgtatgatcaagaaataaatcataaaaatagccaaccagcagccctcaaggctgccttgcctatggagtaggcacgtttttattgcattactttcttaataaatgtgtattcactttac

SEQ ID NO: 263915 - DNA, 418 bp, Homo sapiens
ttagtagccctaggatttctgaagaagccatgtgaatcttgttgtaagtaaaaagcatttaatttaataaagactccaataggctctgttggaaatgacatgtctgagacatataatggaaactttgtctcaattcattgctgtacattgctgttttttttgtaatgtgttggtggatgattagggaggcattagaatgtgaaacaacatgagtaagtatcttaaatacttctcactgttcttctttaagaatgaaaataggtctttcttagccaggtgtggtggcaggcacctgtaatcccgctactcggatggctaaggcaggagaatcgcttgaagccgggaggtggaggttgcagtgagccgaaattgcgccactgcactccagcctgggcgacagagcgagactccatctcaa

SEQ ID NO: 263916 - DNA, 506 bp, Homo sapiens
gcatgtaatcatgtacatgtatgtctttgttttcatcctaactcagtttaattgtttagagatcagtaactatatctcacatatctgtgttttctccagggtctagcacagctttatgtacattaaattttcagtaattgctcattggttgagctcaaagtgatttttggcctcaagcaaggattgataacaagctccatccatttttcctccaacatgtcgagtctacatatctgttccaatgttcctacaaagcatataaacatatactctaaaacatacgatggtacgtttctgtttattctacacttgtttctgtaactttttaatacaaccatacatgcagaaccaactaattcttctggtaactacataaaattctatggtatggctccatcacaatttaatcataggcatacctcatttggttgtgttttgctttattgtgctttattgtacagataatgcattttttaaaataaattgaatgtttgttgcaaaaatgt

SEQ ID NO: 263917 - DNA, 469 bp, Homo sapiens
ttggtcatagttgataaatctttttctatattgctgaattctgtctgttaatattttattaaggattttctcatctatattcatgagggttattggtctatagtgtttttgttctgtctttgtctggttttggtatcagggtaataatcaactttataaaatgaattggtaaatattccctcctcttctattttctggaagaggatgtgtagaattggtgttaatttttctttaaacgttttgtagaccctcctgtgaaaccatctggccctgaaatgtctttctggggagcgtttaaattgcaagttcaattcccttccttggcatagggctgttgaattatctgtttcatgctgggcatgttgtagttcgtgttttcaagaagtggttcattttgtctaagttgtcaaatttatgtataacttcaataatacgttttaaataaagaatccattatttttccttaatt

SEQ ID NO: 263918 - DNA, 411 bp, Homo sapiens
ttttttagaatacaagaatatcaagtacatgtcctgttagctatcattgtgatgaaattatcacatatcatataacctcttgaaaggtacactgtacacttgtgaaagagtgagaatgagaaaggtaaataacgtcttgtgaaaatagtttcaactttacaaagctcctgaaaggatttcggatggcccggggctccctggatcataggttaagaattgctaagttaatacactgacaaaaatggaatgtaccagtaacacttatctattgtaaacctgtatcaaataatatattaaaatattttgtcatagaaatctgttcaaaccctagtttttagccatcacatatattttcttcttttacatgagtctagtctttagatgtattaaaagattctgattaatacattt

SEQ ID NO: 263919 - DNA, 641 bp, Homo sapiens
catgttgctgccagagtaatcctcttgggtgtgagcatggccctttcatgctcgcactactggacatattaccatccattcaccccggtcttgtttattctactttagccacactgaatcttctgatgtttcttgtgcactagttacacgagaggttacataagattagaataacattgttgtgcctttgctgaacgctgttcccttcacctttctctcctctcttcacagaccccaaacctatttgccttttaaggcctggtttgaatgttgacttatccatgaagtctcctctgattgcccagctggagggaatcttctctttcctgagctcctgggaaactttatgagcaatgtttttggtggggatttgggagagcaccatctaccacagatgactgtcagctcccctggcccccgactgtggcctcttagcataacctgtacctgtcacaatttttatatgcatttgaatgatgacttgttgaaacgtattctggaaacttttgaattcaggtgtttacctgagcaagatactgatttggggttcatgacttgcttgccccgtgtcctctgtgttgtgctggtaatttccttccttcctttggctaagtcacttcttgtgtccatcactctcacac

SEQ ID NO: 263920 - DNA, 389 bp, Homo sapiens
gtatctaaaataaaaaaaaaaaaataccgaatgtgcttaacctcaagaaagatcacagaggaaagagccagtacactttaagatacatcagtagaaatcatctagtctgaaaaacaaaagcggggagaaagattgaaaataaaacggccgctttaggatgctaaatgttagggtaatttgttatgtagccgttgatagctggaataattcctgtgagacatggcgcagaaccaaacgctagacaacttgcacttttagtatatgggcgcaccattttggcaatcctcatcttcaggagagtgagactactgattccccccttgggaaattactggactgatttttgcaaaagaaagttgatagcgaataaagcactttacctttttaat

SEQ ID NO: 263921 - DNA, 243 bp, Homo sapiens
gaggatgaggcacgagaatcgtttgaacctgggaggtggaggttgcagtgagctgagatcacgccattgcacttcagtctgggcaacagagtgaaactctgtctcagaaaaaaaaaaaaacgattaaaaatacctcccacacttagctactggtgaacatgctccaccaaaataaatagtaatgaatatatggcatacaggatatctgaccaagagagagtagagcacatttcccatgtggga

SEQ ID NO: 263922 - DNA, 556 bp, Homo sapiens
tcaccgactctaacacaggcaggggcccaagaggactgcatctccctgcaggtagccagggagggcttccctggaaagcagacccttgagagtggacaagggccggtcacaggtgggagaagaggatggcaccgtaggcacgctgaccatggaagcatcctggagggagcaggaggcagaacccatgggatttggaagtcaaatgagtggggagagagacgggtggactaaggcatgtggtccggtattgatcacagtgagcccgagacaccctggaacacccaggagggctcctgcacgtgccgtctccagattctggagctgtggagggtgttggagcagccgaaggaccaggaggactcacggaggacgcgctgccccacccgctcccactgcccacttctcttaagcccttcaactgatacagatgctggccctttaacacgctttgcaaaaccttcacccagcccatttgtgccattattttaggtgtgagagttgtctttggcccaaaggttgaaatgtttatatagttaaatgaatcttttcttcatta

SEQ ID NO: 263923 - DNA, 231 bp, Homo sapiens
cagaaggtggggactgatcagctaccctatgcagacgggaactgaaatgaaagcactggaagacaggcctgaggagatgctgccctggacccagagacatggttcccaggccctgggctctcctggtctggtcacctgcgcccgcctggcactgacttccaacacagagcacatgccccacgcacgtttcctggacaagacactggaagggggaatcagggccccttgtag

SEQ ID NO: 263924 - DNA, 476 bp, Homo sapiens
cattattttgcatctatgttcataagtaaaataggagtttttttctttatgtgactaggtatcaacattatattggccttataaattatgttgaacactttgcctattttttctgtttttccagggcaacttgtattgtaggaatcatcaggcaataagatgcagggaaaactctggatactgcatacccaaagttgaatacatttttcttctttttgaaacttttaatacacataaagacaagtgcacgtattataagtatatagttcagtttatttcgacaacctgaataaacccatgtaatcagcacccagatcaggaaacagaatctggaagcttccttgtgtccccttccaaccactatttcccctcaaagttaatcctgacttctaactgcatagatttgtcttgtctatttttgtactttatataactagaataatagaatagatactcttttgtatctgtctctctgg

SEQ ID NO: 263925 - DNA, 222 bp, Homo sapiens
actagttagtgacagtgtcagttgaaatacagggcccctaacccccagtaaagtactgtttacatttatcctctactgaaaattattcctaaagctggtggccagatgctaaggttgaatcttggtaatatgatgaggcatatgtccttcttaatctcctcttaagggaaagacctttggaaatggaccatgtagggtaaaataaacatatatattcttgac

SEQ ID NO: 263926 - DNA, 557 bp, Homo sapiens
cttctccatgtggccatcagcctttagagcagttaagtaatccatatgttgctttactcttttgtttgttcatccactcaacatttattaatttattaatgttgaggggatgaacacacagtgcctgtctctgtgctgactgtgctgagggctgagcacacaaaggcaaattagccacacagcctgctctcaaatagcttactgcctttcaaggaagagcagacataaaaaagaaatcatgcttgcatttaggattaaatggttggatgatcccttaggctggggtccccaaaccccagggtgcagagtgttacctgtctgggctgcacagcaggaggtgagctgggggcaagcgagcagtaccacctgaactccgcctcctgtgagatcagtggcagcattagattcttataggagcgtgaaccctattgtgaactgtgcatgcaatctagggatctaggttgccccctccttatgagaatctaatgcttgatgatctgaggtggtacgctttcatcctgaaaccattctcaccacatcccagcccatccattaaa

SEQ ID NO: 263927 - DNA, 500 bp, Homo sapiens
acaggcgtacacccagaaaaacagcttgagagaagagccagagccacagccagatgctcagtcaggaagtatccacaccactccaaacactgccagagacactgtcagacacacagtcagacacactgccagagacaccgttataaagactgccagagaaacagccagacacacagccagaaaaactgacagagacgcagtgccagatacaccccgagaaagtgccagagactcagctccagacagtgcagacatagcataacagagacaaatgtgggtatcagcctgaagcagctgcggagaggctggagagcaatggacttcctggggcttcctgtgggagagggctcctgcctgccttttgctacccttgaccctctccaggaaagtcccctcctctgagcctgcttttcctttcctccctgtcacagccacaggtgccctgactgcccctccctggcacagtaaatctctctgtgtcctaagtggccccagctacc

SEQ ID NO: 263928 - DNA, 693 bp, Homo sapiens
gtggatttctatttgctgtggcttgctggggattgaagggattatggttgatgagaggtttgaaattcaaccagtttattattagtgggggcacatgaagtttgaaaatcttggttgtcttgatctgtcttttttccttttcttcctttaatctttccctccttaccccttccctcccctcccctacccttcccttccctttaaatgtaaggggaaaagggcacactggtcagaaatgcaatgagctagttgttggtttttgtcacaattattcatatgtccacttctattttttcccacttgatagttaaaccaaacatctagtttttactgccttctcaaagtacataattcatttaggttcagtgtacttattgagtgacttatgtgcaaagcattgtactaggtgttctagtactagtgtaaagagtaattcacattaaaatggaaagatgatgactgagtgaacaaaatttgggatgtcttgcctcttgtgtttttcacgtagatgttgcttacttcaaatgacatgaacaaaggtcctcatgtaaagctggaggaaaaacaaagtcaattgctttaagctatggttggtagttggtaattcgtaacactaattacagctgatacgaagactacaatagatttgttataagtacctataattcccctttatcaggcttgaattatatt

SEQ ID NO: 263929 - DNA, 1488 bp, Homo sapiens
aatttttatcctcaggagtgaataaaatcatgtagggaaagagtgttcatagaaaagcaaagaggaccaggtatatctctggagttttccagcatgtttatgggtctagtcaaggaagaggagccagccaaagacatgaagaagaagctgccagtgaatgtgagataggagaccagcctggaggaggaaatgtttcaaggaaagcatggctgtgctagttgctgctgaggaagggatcaaggaaaatgagacagagatttagccttagcaaaccattgctcattggcagcctccataagatctgtttgactggagtgatcagatgaaagcctgatgggaatgagttgtagagcaaataggaggtcaagaaagtggagacaatgcaaggcatataataactcttctgaggactttccattgaaaagagaaacaaggtggtagctggagaaaaaataagtattatttttagatgggtaataactgagatatgtttatatctcagagtgattctgtttctgcagttgatatcagtgaccattttaagtctcttaaaatactttcatccgtaatttctgttacacaacacttaattgcttctcttcctacctgggctggtttattctgtccttttgctcagtcacctactctccaagagatgactaccatgtatagttgtgcaggttgtaaatggtaggaacataagcggcacagtttacaccaactaccttgtaaattgtgtctccagagtcataccgtgcacacttagtctaactctatgagctgacccttattaccagccccagaacacaatttttatttgaagcacatggaaacaaattctatgttggtgttgtgggcctacagtaagtagtggaagcgtggttaaccaatcctgaagctacaccacagtagcaataatactatacctacagaagaaaaatgaatcagatgcagtagaaaatgttggattcctaaaaaatgtccacccccaactaaaatcattgtcaaaaataataaaacaacaagagcttttctccctccatttaggcttcattttcaaagcaacaaactgaagtataggtagtaaatttctacattgagagtcagtttgcaagttggagagaaagcactgcaaatccaccctgcctgttcaaaacataagaagcaccagttaaaatctacctatattagggaaaaaaagaaaaaaaaacttcaattaacaacttgactaaatgaaacaattgaaaaaaatagaatgttccttacacattacaacatggatgaatctcaaaacagctatcctgagtgaaaagtcagacaacaatataatttatactatatgattacattatataaattttagaaaatgcaaagtatagtaacacaaagcagatcagtggttgcctgtggggaggagaggggcagcagaaagggattaccaaggggcacaaggaaacttttagggtgatggacatgttcattatcttg

SEQ ID NO: 263930 - DNA, 739 bp, Homo sapiens
tgtttgcttggggatctgatcctgtagtgatgaccattgagaatgttgctgtgcgttcagccatgcaccgccatgggtgttcactgggctttctgacctctcgtggccttctttcgtccttttgatggtatgggcttcctgtttccagaaacctcatctctctcaagaagatccttgatgtgctttgagatttcacagggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcaggtgggtgtggaggtg

SEQ ID NO: 263931 - DNA, 893 bp, Homo sapiens
tgtttgcttggggatctgatcctgtagtgatgaccattgagaatgttgctgtgcgttcagccatgcaccgccatgggtgttcactgggctttctgacctctcgtggccttctttcgtccttttgatggtatgggcttcctgtttccagaaacctcatctctctcaagaagatccttgatgtgctttgagatttcacagggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtgaggctaggaatgagaaattgtggttgtcatggtcatcattaacgtggacatgtggtcgggctgtctcctgggcacttttccctgatatgaacactgacacagcagatgttttcagaaacttccaaaggtcataacgatgctggccatacatgatactcacttttgtaagtcttgcctagtattctccacagtaatgtgtgatctgcttaattcacagtcagcagagggcatgggggcctttgaattctgtccttgggagtttcagagccaggacataacatgcttgttttgggcctatgtgtgctgagctatattgctgttccttgccagggaatgaggtagatccgctagggctggccactcagaagttttcaaccctggcgctctattacttctttaaatgattcttcgactgcctgatggaaccagttggctaaggagcatccaggcagagtcctggacgtggggctgggaaggagatggc

SEQ ID NO: 263932 - DNA, 556 bp, Homo sapiens
gaataattgaagattgcctgttatttataaagatgtaaaatgtgattattttaaacatgttgaaaatgtattatttttctgtaagctttgatgattatagacttacatctttataaagatttaaaattcatatttataaaaatgaagcccaccaacttcattctttgtgtacctaatcagttttccccagaatttttctaccatttattgatcctcagtaaggttccaaaaaacctcacatagcactatagacaatctcagaattaattctggggctagaaaggaaccttcattgatcatgcagtcaaacagcattccaaagaaataatttgtccaaaaaaagcctccacagaggatttatatagtgaagctataaggcaggaataccaaaccatgaacatctctgcaaagtgagtacattgcagaaattgaagagtttttgttttttgttcatttgtttgttccattgttttcatacaatggtgacataaaaaaacagattggtatgacagtgcatgaagtaggaacaagattgtaggagggtacaccatggttt

SEQ ID NO: 263933 - DNA, 186 bp, Homo sapiens
gctagcaaatagaagtcctggtacatggaagacactcaggaatgccacatctttcctctgagactttgctttctgttagcatcccagtggcaacaactagagttgaagggactcattttcccaacagagagattctcagagtaatggttttcaagcttttatagctacagccctaggcaaaaaaaa

SEQ ID NO: 263934 - DNA, 821 bp, Homo sapiens
cagggacatttcttcctcttctaaactaaatgatcccgaagacacctgagattcaatgagagagaagggtgagcccggggtagaatggtaagactcaaaacctggcaggtttcttttacagtgatttattgctttgatttttaaaaattgcacaaataaaatagaccattcagaattaaacgtggaagtcctccttttaatgtccccattcacctgcctcgcatgtgtgtcatggatcttcctagatctacttctacgcacgtgagtgttgtgtgtgtgtgtgtgagtgtgtctgtgtgagtgtgtgtgtatgtgtgtgtaatatgggtttgttggttaaattctttacacaaatcccatcagaatatgtatgtagataatttctagaaatttcttttttcatctaatagattttgaggaggatcactctgtgacataggcaatattaatttcatttactcttcacaatgaccctatgaggtaggggctagtgttatcgtccgttatacagatggagaaactgtgacacagaaaggctaagtgagttgcacaagatcacacagcaagtaagtggcaaagctgggattgaaacctaggctatctggctttggagcacgaatgcttaatcactcttctgcaatacttggctttaaccactgcatcacagtctagcctagagatggaccatagtatatttataaccactgcccttttgatccatatgcaggctgtgtccagggttccactagtataaaaaaggatgcagagaagagctttgtgcagcagccagaggggttcttgcagggtagtggcccagctgt

SEQ ID NO: 263935 - DNA, 458 bp, Homo sapiens
acatttctatgccaattattttattaaattctcacaatatcccttggagagtttacctttggttttcactttatagatgaggaaacttagtataagagaactggagttacatggattgtaaatagcaaaacctagatcttaacctatgagaatgattctaaaagaatgttcaaccacaatgctccatttctcaattaaaagctacagtatactgcaaagtgccagggaattgttcatctcttctgtttgggagaaattgtatttggagagtaggtaagagacaaagttagaaagaaaggtggaagctgcataaatataattttataagcaatattaaaatttctacatctttattctccttagttggcttagtctgggatatgacatgaagttaaaacgtgcatttctagagggggttgtgcacatatgtatacatccaggtctgtaggtgaagaaga

SEQ ID NO: 263936 - DNA, 591 bp, Homo sapiens
gtaccaagtctcccttagactggagaaataaagttaagtgatctattgcactgcatgatggccacacctgataataacatgttgcatatttcaaaatcactaaaagaatagatttttaacattctcaacacacacacacaatgttaagttggtgagatgatgaatgtgttaattagcttgattaaatctttctacaatgtatatatatgtaggtcaaaacatcacattttaacccataaatatacacaatgtgctaatttaaataaaagcaaggggaagaattgaaagataagccacagaccagaaaatatttgcaaaatacaaatttgcttaattacttgtacccaaaatatatatttaataaacaactcttaaaactcaacaataagaaaacaactccaatataaaatcaacaaaatatctgaacagacatctcaccaaagcagatacacagatggtaaataaacataagaagatttgctgaacatcattggtgactagggattttcaaattaaaacggcaatgaggcggggcctggtggttcacgcctgtaatcccagcactttgagaggccaaggcagatggatcac

SEQ ID NO: 263937 - DNA, 349 bp, Homo sapiens
tgtgttcattcctctgtctctaagaagggcactaccctcactcaggacctttccttttcaaaacatttttccaaggaagtaagttccactggttcccgtgctggggtgctaacaatcttgccaatccggaagtttggcctcatggctcctgctgaacaacttcaaatagagtgtggacacaaagtgctctcctagaaacttgataaacgttcacgagaggaaagcaatggagctgctacataattatttcaggtctcaaagcttccaagaagtggactttaaaatgcaacatctcctagagattatatcaatctctttgcttgtaaatacaactcctttcctgatccca

SEQ ID NO: 263938 - DNA, 447 bp, Homo sapiens
aaagatctttattagcttacaggtcctcccaccccgaattgagtcagatgccaagaaatcctgagctcagagactggagcatgcagtgagtcaatgaggcagatgagggtggaaataatgctttcctggatgaaatactggtggctgtgggctgtggatcaagaggagccctaagcctacgacagtgcactgaagctagagatctaggattcaaatttaagataatgaatgggatgatcactggcctcttccctgagcctagttatattgtaggcaggagtctctgaaaggagtttattttaggacaagtaaaaataaatcctggccaggtgtggtggctctcacttgtaatcccagctatttggaaggctgaggcaggaggactgcttgaggccaggagttcaagaccaagctgggcaacatagtgagactctcaactcttaaaaa

SEQ ID NO: 263939 - DNA, 299 bp, Homo sapiens
cccatatgaaaagtttctccttctatttccaagcttgcttttcagaaagtaccgtgtgaatgaagagtagtagaatgaagaatatgtgattacttaaaataatgatttgccttctgcagactacgtctaagaacaataggacatttttataaataactttcagatagcacttttcatttagtgaatgtgcttttctatttggtatctaatttgtaattctctaacaaaatttgaaattataggctgtgaaatttgatttaaacatatttaagatcaagacagaaaatccctgagttttt

SEQ ID NO: 263940 - DNA, 264 bp, Homo sapiens
aggcagttgtgtctaataaatgctggttttcatctgagtcaggtagtgctggcagctataaagtctggcttccaaacgcagttctgtgctgcgtggcctgggacaggtaacctctctgggccataatcttgcctattgtgccagccccagcctggagtcgctctggttaggaaggtgcacgcggcgtggggccaggaagcctgtcctccagggtccctactggaaaattaaaacacagggcattcattttcttctaagatgaaa

SEQ ID NO: 263941 - DNA, 412 bp, Homo sapiens
gcagaacgcctctggaatgaggcatgaccttggagacatatttttatacagtccaattattccccaaaggtaatgacacaactaagattgatcaactagcactgccagcagatggaagacttaaggtattgattgttcaagggggatttggccagcacatcacagcatccacattgaaaatcaacttaggtagcaattctatagaacatacaatgtcagtgacatcaaccttgaagctacaaaaataagaggttcttttagggtcaccatagaagttctctagtttccagaccaagacttaagctgacaattttaaaatttgagtttattattattttattctttataagaatttcagtgtaatcaagaaaagcatctcactctatgatccttatggtcattgtcattgctg

SEQ ID NO: 263942 - DNA, 1006 bp, Homo sapiens
gactgactgcttctaatgtgtcaccaaagccgaccagcaggtaaatatttatttgagccaatatcattatatatgcatatgctaggctctgtggtataaacagggttgaatgctgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacctggggtctccctatcttctcctgcatcatcatcagcactattgcaagtgaagacaggcaaagcaatattcccaatcacaaatcctgtttctctgccaaaaagtccctggccttttgtctcccacatgatagaggccagtctttcgtaggtcaaccaggcctgtcccccacctctttcctatttagtttctaatttttgagtcaattagatgataaataaccctttccatgcctgttcatcaaataagaaacaaggaagaccaaattacacccttctctttctgtactgattcattttggtgagtaagatgattcctggtttaaatagcagtgtcagcttcagggtctcctattacaggaaccaattctccttgcttgcattcagtattcctcaagatagcaattccacatcctgctagagcccttcccactttgatagtaccaactcaccctgcttgcgttctttgggaaatttattatttaaggcccttgcctttgaagctgggaaaaatccctgatgactttctaagtgtaataagctatagtaaataagatgtaaaaacacaagtaactttttataacactttaagtagaattataagtgataatacatgatggcagaaggttcacaaatagtgtttctttcacttccaggaccagaccctttcatatgtttcccccaagtctacacaaatgattataaagaatag

SEQ ID NO: 263943 - DNA, 558 bp, Homo sapiens
gaagtaaaaggtttttttaaataaaaaatgtaaagcctattcaaaagtacagttagcagaagataaagaacaagccatgaaaccacctctcctctgagtcttgtcttatttttctattttgaccgatttccttctgtgtttgttagcattaggtttggcagcatcgcaaaggtccctgtattccctcttcccccacaaaaaggtgctttaaacaagatagaggttttttcctctcaggatatggcagctatgtggtcagcaaagacccagctcctatctttctgtgttgcagtctttagcttatgactttccttctcagggttatctcctggttgcaaagaaggtccttgcagctccatccgttgtgtttgtttttcaggcagcagaatcgaggggtgagggcaaaatggcccttctctctgtgaagttggtccctttaaaaatctttcccatattcccacccactgatttctgatattggccaacctaatcttcaaggcaggccagaagatgtaaattgccacttttagtaatacagcagtttgatttgtaaaaaaa

SEQ ID NO: 263944 - DNA, 486 bp, Homo sapiens
ctagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttg

SEQ ID NO: 263945 - DNA, 472 bp, Homo sapiens
caaatatagttttaccactcatttagtcactcttatgcctttcactgatttctcttatctaattgcactggctaatatctctaacagcagcagagataatagatatttatctcttgcttctgatgttagtagaaacatccctaatgcttttccattaaataagataatgactttaggactatgaaccccccaaatttgagacaagtctcagttaatttagaaagtttattttgccaagattgaggatgtgcacctgtgacacagcctcaggaagtcctgatgacatgtacacgaggtggttggggcacagcttggttttctgcattttagggagacatgtgacatcaatcaatcaatatatgtaagaagtacattggttctgtccagtgaagggatggcctgcccctccacacctgtgggtgtttctcatcaggtaggatgagagactgagaagagaaagagacacagagac

SEQ ID NO: 263946 - DNA, 245 bp, Homo sapiens
gacaaaggggaattaaggttacagatggaattaagattactaatcatctgaccttatagggagagtaccctgggctagccaagtgggtccaaaataatcacaagtctttaaaagtggaaaaggctgggccaggcatggtggctcacccagcgctatgggaggctgaggcgagcggatcacctaaggtcaggagtttgagaccagcatggccaacatggtgaaaccccatctctactaaaaatgca

SEQ ID NO: 263947 - DNA, 618 bp, Homo sapiens
aagagaacattaaaaataaaaatattatatgaaatgcttacagagggctgggcacggtgactcacacctataatcccagcactttgggatgccaagagggggcagataacttgaggtcaggagttcaagaccagcctggccaacatggtgaaaccctgtctgtagtaaaagtacaaaaattatctgggtgtggtggtagacacctgtcatctcagctactcaggacactgaggcaagagaatcacttgaacccaagaggcagaggttgcagtaagctgagatcgtaccactgtactccagcttgggcaacagagcatgactccatttcaaaaaaaaaaaaaaaagtgcttacagagaatgcattccagcatccctcatgaaatagagatgatttttttttttttttgccaagatccccttcagtcactgatctctattcctccagtctgcatgtagtgattcccaaccaactcacaggcaatatctgtttcacaaaatctggatggtagagctgacagagggtggcgctctaatatgcaccatcacactagacacactgacatttgcccacaagtcccaagagaattgccagattcccattgccttcagattttcctt

SEQ ID NO: 263948 - DNA, 379 bp, Homo sapiens
atgttttattcactgagaaacctgctttgtctagactagtaagttgcatctgaagagacagaaagggagacaccaaaactttaatggcagttattcctaggtggaattttaatacaccatgtgcttttctgagttttctgatttttaacatctttgttgttaaaaattggacaacagaaaagatgtttaaaagacagaagataaagaaagggtgtggacgtgttccacattaaagaaggctaagagacatgacaactaaagagcagtatctaccctgctgtgattacaaaggagaatatccctattttaggaaatacatactgaagcatttttgaaataaacagccaggatacatgtaacttactgacagataattaag

SEQ ID NO: 263949 - DNA, 652 bp, Homo sapiens
atgccggctgtctgtgaaaaagtagaggatgttgacttagtattagtctgacagctctgtaacaatataaattttagaggagcgaataaaacccccatattattttattctgtggctggcataaatagaactcttaacttgcactattgggtatgaattatgtatgtgtgtatatttatatatttgtagataaatacatttgtgcatgtgtccatcagatgactaatttggcccaatctgaaggaatgaaaaaacttacactgttggaactaatactgcagttgattagtgtgtcacactaatcagaggctgtgtctttgtaaggagagttttaaatagcttaaacttcaagaattaaaacttctggccaggcacggtggcttacccctgtaatcccagcaccttgggaggctgaggcgggcggattacttgaggccaggagttcgagactagcctggccaacatggtgaaaccccatctctactaaaaatagaaaaattagtggggtgtggtggcacacgactgtaatcccagctacttgggaggctgagtcatgagaacctcttgaacccaggaagtggaggttgcaatgagccgagattgcgccactgcactctagcatgggcaacagagtatgactatgtctttaaaa

SEQ ID NO: 263950 - DNA, 258 bp, Homo sapiens
gataattactgagagagagcatacagtgattgagagcacagactttggtgtctgacagcctgatctccaagcttggctttgctacttgcccaaggtcagctaactgatacattatttctaagagttgcctcattggtgaaatgagatgccaacctctaagcattcagcacagtgcttgacacatagtatatgcctgataaatgttagttatcaccattatcaaatatttcctgtgtgtggcacctaaagattatcacc

SEQ ID NO: 263951 - DNA, 620 bp, Homo sapiens
caagtttctctaataaatcctcttcatctacctacctacctacctacctacctatctcctattagttctgtctctctggagaaccctgactaatatagttagtaaagactaggtatagtttccaaatcagagacttatttgacctagataaatggaaacagaactaggagattcgaggtaagatcagaaattacaaatagtattgcacattctgagaactccaaatcacaattatcaaaaattactaaaaaaacaagcttaaataatgggctcaaaaattatgaaggtttattgagtagaaattgttgagatttagttcaaaaactaaaagctttggacaggaaaggaatcatgaaaagaaaaagttttatatggcataagacatatatcaataatatttgtggatgcatttaactagagtccaaatccagtggccgattaactccaaccgtttttttgatttctcagggtagtaaccagctgagctgttaagccagtcaaggtcataatagctttgtttactgcatagtacagcatgttctaattatcacccctgcctcactaaccacacagcttatgttcccacactcatctgttatttttatgcctcctacagaaat

SEQ ID NO: 263952 - DNA, 581 bp, Homo sapiens
ccaagatctttgagcatcaccttggatttaatacaggctttcaagtaaatatttgattttaggaaaacctatgtgttgaggctttccttccaagtagaatggagtagctggtagccaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctggataaaacaagtaaaccccaattatatgctgcattcaagagccacatcttaaattaaatgggaggatgaagctaaaaggatgaatagatacactgtcctaacactgaaaggccaactggtgtagctactatatcccataaggtagactataagataaagactaaatataggtggtccataacgtatgatggttcaacttacattgttagacgtaacggtatgctcaaagatctttggaatcctcggaacaca

SEQ ID NO: 263953 - DNA, 1017 bp, Homo sapiens
ccaagatctttgagcatcaccttggatttaatacaggctttcaagtaaatatttgattttaggaaaacctatgtgttgaggctttccttccaagtagaatggagtagctggtagccaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctggataaaacaagtaaaccccaattatatgctgcattcaagagccacatcttaaattaaatgggaggatgaagctaaaaggatgaatagatacactgtcctaacactgaaaggccaactggtgtagctactatatcccataaggtagactataagataaagactaaatataggtggtccataacgtatgatggttcaacttacattgttagacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaa

SEQ ID NO: 263954 - DNA, 357 bp, Homo sapiens
gactagcctcctacactggccctagcagagcagatcaaaccagagcagagtcacctgtgctaactgccaagtcatcaaaccggactttgaaatgaggcagttttccaaaaacgcaggagcttccagtcaccctgaatcagcacaataaaaagtgccctctgctttaaccctataaggaaagcaactttgaaatgaccaatctgctttttgttccctgtttctgctttcttcagccctcttttatccataaagccaaacttctctgcccacttcactggaatactcattctatttcgtagaatgaggtgttgcctgattctagaatcacaaataaaagccaatttgatcattacaaat

SEQ ID NO: 263955 - DNA, 681 bp, Homo sapiens
tttttttttaactatgcaagtctcattacatttaaaacccttttttaaacttggtcccttttctgtgccaactttatgtttgtttttgttcttgtttttgtttgagatggagtctcgctctgttgcccaggctggagtgcggtggcgcgatctcagctcaccccaacctctgcctcctgggctcaagtgattctcctgcctcagcctcctgagcagctgggactacaggcgtgcaccaccacgcctggataattttttttttgtaattttagtagagatggggtttcaccatattggtctgaaactcctgacctcgtgatctgcccgccttggctggagtgcagtggcacaatcagaaatactcttctgatgtaactcttcagtaaatggaatacctcgtggtattttataaaatgctgtgtttatgtttccatagccatttacaaggaattttagcataatatgatcacacttagcttctccaactaccctgtgtcagaggtactcctattattagcatttttggaatatgaagagcaaggatcagaaaggtcaagatacctgcccaagatcacacagctaatgaggtggtagagccaagactccaacaaaggagtcttgttccaaattctatgctctcttcaccaccctagggtcttatttatctctgagttcctaagg

SEQ ID NO: 263956 - DNA, 369 bp, Homo sapiens
aatctcagtctgtcgcccaggctggagtgcagtggcacaatcagaaatactcttctgatgtaactcttcagtaaatggaatacctcgtggtattttataaaatgctgtgtttatgtttccatagccatttacaaggaattttagcataatatgatcacacttagcttctccaactaccctgtgtcagaggtactcctattattagcatttttggaatatgaagagcaaggatcagaaaggtcaagatacctgcccaagatcacacagctaatgaggtggtagagccaagactccaacaaaggagtcttgttccaaattctatgctctcttcaccaccctagggtcttatttatctctgagttcctaagg

SEQ ID NO: 263957 - DNA, 352 bp, Homo sapiens
gttgcggtcacacaaaagcggccaagccccacttttccagtaggccctttggacaaatcgaaggaactcagctgaacttccaaatggccctaaacgccagatcggtgggagcagctaaaacagagagggaagagcaggcctcccgcgcccatctaccaaaacctctggcaatatccaagtattcatccaggagcgggagctgagaccattcctaagggaagaaggaaaaggaaaacccacttttactatcaaggcccaaaggggatattaaatattcacattgttgtagggtttctccccttaatcagggtagaaacataatgcggaaaagtctggatccaccaaaaagaaa

SEQ ID NO: 263958 - DNA, 445 bp, Homo sapiens
atgttttccagctgaaataagtgaaggaatgaaggggaaactattcttagaagctagccttcacaagccgaggcaattccaaagcccaaggcaacaacaggagccactgtggcaaagaactgggaagtgagcacacaggagagtgtggaaactatgccatcattatttagagcacaaactccctggatcaggggatgttgaagagagagggctcaaaaggaaaatacagaatggggaaaaaaagggtcaaaacagaccgcgcaactgggcttgccatcattgcctatttctcaacttggcaagaatgcaaatgtctcatatgtcaccctgagagaaatatctgtggattcttcctcgaggaatgataaaacatgttaacgtcttcaggaggattccccccaatcaggtttaagttcagagatcaaggagatcaggtaacacacag

SEQ ID NO: 263959 - DNA, 502 bp, Homo sapiens
ccacagaccgccctgtagaatctgccagggattctcaggacatgactggggaaaggcatcaggactctgtgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaa

SEQ ID NO: 263960 - DNA, 505 bp, Homo sapiens
gtcaattgctaaataacaaagaagtcaaaaaataataataatttatcatttatttgcttatcaggtagacaaacatcgcaaagattaacagaacctaacattgatgagtttgtgaaaacactgactcacttacacagtattgctgagaatgtaaattataaaacctgcctggaagtcagttttctcaaaatatataaaagtgtaatttatgcatactgtgaatatccccattttggaattatcttaatgtgatgttcaaacaagaaaggtaagacaaaaagacattaatcacagttttgtttataagagctaaatattggaaacaacattagtgtccatttataagaattgcttaaatcaattatgaaacatctgtacaatagaatattactcagtcaactaaaataatggtgttgatctatatttactggcacaatgatatctatgaaaaattgtctcatcaaaaaagcaattacagaaacatataaaaatataaatatttatc

SEQ ID NO: 263961 - DNA, 711 bp, Homo sapiens
cacggaattatttaatctttgcaccagcctcatcaggtgatgctctggttcccattttatagattgtggaaacagagactacttaagaggtgccaggctgttgacacatattttatcctttgatcctcataacaaatctgtaatgttagtaatattttaattttcaagtaagggtcctgaggcttggcagtcagcagtttcctgtcccaggttttactgccgaagggaaagaaccgaggtttatacaaagatctgtctgaccctcaagtctccaagtctctgccattaactgctctgcttgcagttcttacccaagatcccacaactgatgcttggttaagtcaactcaagcgcttagacactgtgggtgcttcatggagcttactgaaaacaaagtgagtcatggataggagtttgacattgtaacacttgagccatacatccatttttgagaacagggtggccttcctggcgccctgcacccatccaggcaagctgtgggtggtaggtgtgtttcactctggagcagtcagttggaagttttgtgtcgactttaccttctgctgtaatgcatcttgtcactagacttagtgacttaatttgatctgtaagcaccctcacagccacgtggtgttactgtatcacatttaatgtcggttaaaaaacactctaaaaaaccacccctccaccactgccccccagcgacaaaac

SEQ ID NO: 263962 - DNA, 769 bp, Homo sapiens
catttattatttccgcagtttgaggccatgagtcttgttttaaacttttttgttctccccgtaatattttgcacataataggccttaattcattttttatttatttggtagagaacatttactttcagataaaagtgtaagactttattttcatttgtacggatattatagccaaggattttactgcttttgtttaaaaggatggaagaagtgtttttaatagttcttggtagttagcattctacaaaatataattgaaaaattctctggttttattttattactatgtaaatgggtttcacttgtttaaaatgttaaaaaacattgattagagtacaaaactagaaatgttatcaatatttcttcattgttttagtgttttcaatttctaaggaaataaaatattttataaaaaataattttgtggcagattgttaaatggaaatacaatgtacttctgttgtcttagtttctaagccattgaaaactatgtcaaactaaagtcattttaggttttaaagttttaggaatatatttgatttcaggtacataaagcaaaaggaattataggaaagtatatgtaagtgtatagataattgaatatatacactttaaaattcttttgcaagttagcatgaataaaaatggtactttagagagcagcttaaatacctctcaggtgaataaagcatgggcttcatgcttgtagttggggatatatgtatcatctgctgtagatgtattacaaaggtgatgtcaaggtgaaagc

SEQ ID NO: 263963 - DNA, 1541 bp, Homo sapiens
agtttctccctaagtgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatga

SEQ ID NO: 263964 - DNA, 1584 bp, Homo sapiens
agtttctccctaagtgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaactcattcttcctttgatatttgagagcagatgaaagccgagg

SEQ ID NO: 263965 - DNA, 1415 bp, Homo sapiens
agtttctccctaagtgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatga

SEQ ID NO: 263966 - DNA, 729 bp, Homo sapiens
cgacagggcagtgtaaggaggagctgtggaaggggaaatagatgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatga

SEQ ID NO: 263967 - DNA, 1525 bp, Homo sapiens
agtttctccctaagtgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatcccctcttccagagccttcgggttctcaccaaagggacctgggtctagggcctcctggaaggccatgccatccttctccagcagctcaatgatccaactgagctcatcagaagagctggaagctgacaaggaaggaaggaagggtcacactcccctaatccctccctcaagggctctctctggctgtgcagctggcccagagcttgcagggcacagcctacggccacactgaactcgactcagctcaacatgtggagactgctccccttttccagactgggtatactcag

SEQ ID NO: 263968 - DNA, 1215 bp, Homo sapiens
agtttctccctaagtgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacagggaaaacagcaagtgcacacagtgggacaggccacaggacaggctgggagtgaataaagagttcacactgcttccctgctttccccagtgactgaaggctctaggccacctcctcctcagcctcctcctcgaactcgccctcctcctcggctgtggcatcctggtactgctggtactcgacaccaggtcattcatgttgctctcggcctcggtgaacttaacctccgtgctgcccgcacatccgtacgaaccggggccgacc

SEQ ID NO: 263969 - DNA, 1134 bp, Homo sapiens
attttattttaattagacaacagttttgctcttgttgcccagcctagagtacaaaggcggaggttgcagtgagctcaggtcgtgccattgcactccagcctgggcaacaagagtgaaactccgtctccaaaaaaaaagaaaaaaaaaggggttaatccttactttgtaaatgttttaaaaattgaggggaaaagattagaaatcctatagaaaagtgggcaaaagtcatgcacagactctttaccaaaagatgtataaacatatgaaaagatgttcgttcaacttcactcatggtaagagaaacgtaaattacaactacactgagataccatttctcacccatcagattgtcaaaaacttaaaagcttaaccgtactctctacggataagactgtggagaaacaggcattttcatacattgttggtgggaatgcaaaatgttttaagtcctatagagggaagttggcagtatttaattaaattatatatacacatacctgttgacacagcaagcaagcgcagggataaataagaatttatcccttaagagtcacctccaggccgcatgcagtggcccacgtctgtaatcctagcactttggcaggcccagatgggcggattgcctgagctcaggagttcgagaccagcttgggcaacatagtgaaaccctgtctcaactaaaatacaaaaaatgagccaggtgtggtggcagttgcctgtattcccagctactcaggaggctgaggtatgagaattgcttgaacctgggaggcagaggttgcagtgagctgagatcatgtcactacattccagcctgggcaaaagggattataggcgtgagcacagccccgctaaaatcatattcaagaagcaattcagtttctttctaagcttgtagtcaggggtcaatgattttctagcctgaattaaccagtttaagtttgaggaaagtcctcttcagtgggttcaaatgacatgggaagcaaaaagagaattaaaaaaaagacaaagaaaagggggaaaataccggaggcagaagacacattggaaggccatgagattaaagaggggaaaaagaaacgttgagctgggtgtaaaaagaaaatatggtggtgataataaaaataaaagaac

SEQ ID NO: 263970 - DNA, 261 bp, Homo sapiens
gggtaagaaattgagattgagcatgaaatatgtccagtacatccatcagcctgtctttgtgctctggctatttctgagccagccatctgtgtacaagtgtagcctgacagcaccctgtttcagatccattggatatctctaaaatttgctctgggacttaccctggcactactatcaggatgcccacacaaacctgattgggcagcccatcagcagttgtgaacatgacatggtgaataaacactctcttccttgtcacag

SEQ ID NO: 263971 - DNA, 678 bp, Homo sapiens
tttttttccctctctcaacattatgtttggaagattaatccgtgttgatacatgtagctgtttcattaattttaattgctgcatggtgtccactctgtaaatgtaccacaatctatctatcgatctgctgttcatggagatgtagatgctaattttttttggctattacaaatcatcctgcagcagatactctcacggcggactttcacaaacaggagttttctaggatataagcctctgtgggcagtgactgagtcgaagggcatggctcaaactctttcccccgatctctgtctgcccgctctgctctccccactttaagtaccttctttcccggtggttctagcatatctccggattgtgtcttagtgtccccacttgggtcatgggccgagctcggaggtcagggaaaggtcaggatgctacggctaggggtgccacaactgctgagcactgctgggcaccgtgaggtgctgcttcgggtagatgggctccagctgttaggaggaagtagttcttttgcttcttgccctgagctgtcttagaaagcgcccagtcttggctgggcgtggtggttcacgcctgtaaccgcagcactttgggaggtcgaagtgggtggttcacctgaggtcaggagttccagacctgcctggccagctaaccccatttctactaaaa

SEQ ID NO: 263972 - DNA, 265 bp, Homo sapiens
cgattgcggtttgcacactttgagggtgaacagttgtcatgcagcccttttgagtgctaaaaagtgaccacttaagattttcctcgtggttaggaagatgagtattttaaaatcattctggaggagattagtggtaaagaaaaccttcctcagcaactaaatcattgtggaaaaataagccaattagtcactaaaacaaaaaccttttgaagacttgtgaacagaggaaagaacatgtgaattacaggttttctgttttgtggca

SEQ ID NO: 263973 - DNA, 230 bp, Homo sapiens
atatttttgagttcatagtatatgataggttattgcaaaatataactgtcattaactgagtttgttttatttcttgataatcatttttatgtcttggtttatttaatatatatgctattgatattaaaagttccattatttagtctttccatttattcataggagctgctgtcaccttcagtagcctgttgctgagtacttactaagaattaaatgagaattaagtactg

SEQ ID NO: 263974 - DNA, 373 bp, Homo sapiens
tgagaccagacaagaatatcaaggaggcatgcagaagttacaatgggaaatcaaaaagaagacaaaggagggacacctaattcagaacgatgggtttgttggataggagagaaaaggagacgaatgggcaggtatcatcaaagattcctaagaagaagttcctaacttctgtttttgtgccattgactctttggcagtgtggagaaacccagggacccattttcagaacagtgtttttaaatgcataaaatattttggattaaaaggaaactctgagtattgaaatacctaacaaaatattttaaaagcaaatttgtaatacagtaatgtatatgcttctttattaactaattaaagaacaagatatagcaat

SEQ ID NO: 263975 - DNA, 407 bp, Homo sapiens
ggattatttatatatttatgtaaatatatcatttgtacattcttttttgaatactattaatgaaattttctttacttacaagaaatgtattttagtgtatgtataaaggccactatttttattgtaaaccctatagatcagataacagcatatattagtaagggttccctagagaaatagaaccaagagaagatttatatatcagataggatatataatatcttataaatatatataatattatacatataatataatgatttagctcatgtggtcatggaggcaggcaagttcaatctgtaacgtgggctggcttgctggaggccctggaagaactgacgttccagtttgaggaaagtcaggcagaaagagccattttataaatgaagtctggaagcaatctgctg

SEQ ID NO: 263976 - DNA, 331 bp, Homo sapiens
ttcagtccaaaaactattaggtgaggtcaagcatgagaggcatcctctatagaaagacaagttgtggtggcccagagcaggctgctgggctcaggcagggtgggaaggggcagctcagcatgggctcagatcctgagcagggtgaggaggggatccatgcagcggagcgtgggatggaagaaggcagccctacatgggatgctggagtctgagcagggtgaagaggctgtccagatggggcaggagaagcagtgtggcagctctgtccgctaagagtgcccagaacagctacaccccaacaccaggagcacacctatagcccccagttatg

SEQ ID NO: 263977 - DNA, 341 bp, Homo sapiens
  misc_feature (32)..(32): n is a, c, g, or t
  misc_feature (110)..(110): n is a, c, g, or t
  misc_feature (121)..(121): n is a, c, g, or t
tattcccggaaacctttcctgaaaactctgcnggaaaaagaacttattaaagatcaaatttttggctctcatctgcacaaagtgtgtgaacgtgaaaattccacagttcngtggtttgtanagcaatgcattgaagctgttgagaaaagaggtctagatgttgatggaatatatcgagttagtggcaatctggcaacaatacagaagttaagatttattgtcaaccaagctcctgcaccaccctcactcacctgactgctcatcgtttaagatcattattatgtgacacctcatctggaaagccttctgactacacccagatgaagcttgatgctaatctt

SEQ ID NO: 263978 - DNA, 931 bp, Homo sapiens
aaaaaattaaaacagtaaaataatgacaattgcagagacaaatataaggtaggagagacacaattctctctgccaagtctggtgtgagttccctaaatgaagaatcgagaattggccattttgcatggcctctgcagggtggtctgagggcaggcatcacagctagcgcacacacgtacctgtgcagtgttttccagaaggtaaattctacttcctttaaatgttattactttaatttctggtactttaacaagttaaatttagtattttaaatctgataggctgggtgcagtggctcacgcctataatcccaacactttgggaggccgaggcgggtggatcacctgaggtcaggagttcaagaccagcctgaccaacatagtgaaatctcgtctctactaaaaaaaaattacaaaattagccgggcgtggtggtgcatgcctgtaatcccagctacttgagaggctgaggcaggagaatcgcttgaacccaggagacaaaggttgcagtgagctgagattgtgccactgcactccagcctgggtgacaagagcaaaactccatctcaaaaaaataaaaataaaacaaacaaataaataaaataaatctgatattttaaaaccacacaccatggctggtcagaagtctttatgaccatgaattaacaagtgtttgaattattcttaaaaatgttagcaaagaaatagtctgtgcaaaatctcaaggggaataattttgtttcacctttagtctacattacggtgagcatctgtattcagtcctaaagtttttaaaactaattttttaaattaacaaacaataattgtatatatttattgtatacatgatgttttgaaatatgtatatgttgtggaatggctaaattgagctaattaacatatgcattacctctaatacattcttatttgtg

SEQ ID NO: 263979 - DNA, 602 bp, Homo sapiens
tgttggcgggatagatggatcacaatgtcaggcacgggaagcactcaataaatagttgttgaattgtaccgagttgtagtggctaaatatttcatggttctctattcttcctactttatgccacttaccatgggctagaaaataagatgaagctgtgtttgcattgaatagtggtaagtggttgctggttgtctgaagagtcatagagcttttagtggttttacagctctgattctttttttttgacagcaatgtttactatttctggccattatgtacactaatataaaaatttaattagactctttcttttcaattaattattacagccctgtttgtttgctctctcgacagagcctgctttatgggaacaggagagatcaattttctatcacaaaattcattacttttgactaaagtccagtgcgcctgtgagtgtgtgcaccactcttgatgacttcccgggcagccagaggattgtggattctgccgagtattaaagtagccttggtgaagggatgcttttgattcaagaagagtttgatttgatcattgtccttctcaaagcagcacatgaagcaaaattaaaattctgtacagtt

SEQ ID NO: 263980 - DNA, 1266 bp, Homo sapiens
cagttgctgattatccttgcatataggaaggcagaattgtcttctcaagagtatattgtcacagagccttgaacattgtccttctaagatctcttttcaaaatttcgtagttcaaacagaagctctctcttgagttccctacatttctaaattgcagaacaggcactgtcatggctaaagtgtctgctaattgccagaggtgctaaaagttcctctccatcttcaaaaagcccatgttctcaatagcatccaagatgaagagaatagaaggaacaacaggctagaagggaaacatcaggactctttaactgcaaatggttaatcaagtctccatccactcaggtctatagaaagacccataataggaatcttccagaggctaagatacactcacagtccagggcactgtacctttcccaatgggactctaagtgattcatcctccaggaaggttcagaagcagtcaggacagggccaccaggtgttctggtggaagggaccatgtaatatgttgagtttttacaatttgaactctggacatccagagaactacaaacctattggggtcaaacaggacatcacagccttggtgaaaagaattgctggcatttccattttcaaattaagcaagcctcagccctgagctatcttgaaatactgcaatctcaaaatggtatgaggagttgaatgttgcaggaaagaaagccaacttcaaattgatttgttccaagtctagaaaagcttgtggcctggttttacgatcaagtggttgttttaaaattgcacagggcttactgaaggatgtgtttcctttacaatgagctcataagactacagattggggtgaaggataagaagagtgtgaaaaatataagattaccatttcgatgtagctttcttcgtcttctctggaaacaggattagcaaaaaatcttgcagaattaataccatttctttctggagagagaaagctggttcgactgctaagaataaaaatatagatgaggtcaaagcaatgtcttacagctgctctgaaagctggccaggaactaacatggccctcatggggtttcagccctcctcttccagacacaacttccttccggccaaagcaattcctgaagaggcacaaaatgcccaacagtttctgctccactttggggcaaatggctcccaattcacaaaggctgctttttctcaggccctctatgtgacacagctcatgagctttctaaacggacgagggcatcatatcatttagcaaaa

SEQ ID NO: 263981 - DNA, 371 bp, Homo sapiens
gggaagtcattagtatgttttaattctgaagaatgctttttggaaggtggaagtggagatatagggacgctctgtttatccccttcacacaagcatcctttcttcatggccttaatgtgtcctagttaacagtgaccacttcctaggaagtaaacttgagtttagcagatgtcactggatgaggtctgctctaacaccatctctgggtactcttttcccaggttcaggtcaagtctcagttgggctaatcatgtccaagtgccttctgcttagaggtgtaatgatctcagcagtgatgatctttagttaacatgttgcacaacaatatcttctcttcaatcctcctacggataagcgagaaaaacgttgaa

SEQ ID NO: 263982 - DNA, 172 bp, Homo sapiens
tgcttctcaggcttaagtcaaatgcttcaataagtcattgccatctataagtgaaatctaacggggaaataggccacagacaggatatggggcatggttgctacaaggacgccatggtacactggtttgcaattgatttgtgttctagatccaaaccccagtacctattaaa

SEQ ID NO: 263983 - DNA, 422 bp, Homo sapiens
gggacatgctgccccacttccatccctgggccttggtgcacaggccagaaagtccgagacagaccatctgtcctccctacaggggaccaacttgcacaaacaaatgggcatcagcacccactgggagcagccgtgacccctgggtcctcggtaccagccacaaagccagttctgagtttgttcagaatcctgcttagaatgaaggatgctcctacaccaaagatctcttaatacgaccaccaaacaccacgggattttcaaaggtagctgccacagccgccgcacacaagctctgttcctggcttgcttctgccatctgctggccagttgataaaaggcaccgggggttattttccagtctctctgaggctcttgttttgtgggaggaactcatcaccacctttatcgactcaggtggtgtg

SEQ ID NO: 263984 - DNA, 370 bp, Homo sapiens
gcctcaatccctgctcatgtcacaaattccaaatcaagaaggtttcttcagattctggcaataaagcaaacatgactccaaagggccctctcattacaaattaactagatctttaataaaatataactctcattaacagtgataccatatagcaattgtaggaaacaaggaaaatatcccagctgcctcagtaactgcccccaacccaaaataatgactaaatcataaaatggacaaacaccaaagacttaaaaaacgaattgcagattaggtaaaaactccccagaatatttcgaagtaaaaaatgtaattattgaaaattaaaactcaatggttgaataaaacagcagattaaacacagctcattagt

SEQ ID NO: 263985 - DNA, 404 bp, Homo sapiens
ttcgcggcggctcccttgggtgctgcgcccttaacgggctcaggagccggactgcgcgggtgcaccgccagccggcctccgggaggagcagtgcgctggctgatccgccgggaagtttaaccagcttcctgtggttgctgtgtcgcttttcgcctcctagaacttcccagtgtatcttctgaccatgaccagggtttgcaggaaaccccaaagccggcctttgggcattaacaacagcagcattttattatggaaatcttcaaactgtggagaaattgaacgaaggatataaggaattcactgtactcattacccagtttcagtaattatcaatacgtgggcagtcttgctcccctaatccgggttattttgcgtttttgagacagggtctctgtcacccaggc

SEQ ID NO: 263986 - DNA, 705 bp, Homo sapiens
gtctcatccctaaaggcttgcagggtagaagttgggcacccaacttctaaagctgccctcacagctttgctggatacaacccctgccacagctctcacaggttggagttgcgtgcctgtggctttccagtgctggaatcacacactgatgcctctactgttctggggtctcagggtgacctttccaccttggtactactaggcattgccctaccagcggccctctatagttttctgcctgggtggcacacccatgacttcaggtggctccattcttagaaatctaggtgaaggtaggcttgcccccacagctcatgcactctgagcaccacgcagacacagccaaagtctgctgcctgtgctttctggatgggcagccaagcagcaaaaccctggaatgcagtggagtggagcctgtgatatgagggatgctacacaaagcctgcaggggtccagcaggcacctgcagcccgtcctatgaagttgttctgatgatctctggagcaccttgctatggaaggggttcattcttccatcgtcttgaacaatagcccctggcttctgttcagatggctgacaaaactccatgtaagatgtggccattgggccacacccttaaagttctttaggaacagaccttttcattctttacaatatggaaaggctgagaagtttccaaatctttaagtttggctttctttctgat

SEQ ID NO: 263987 - DNA, 572 bp, Homo sapiens
gggattacaggcgtgagccaccatgcccagctgagtttttgcaaatggatctatataatctctgcatctttataaggacaagttttttaaattttatttttaacatttttaaagagacagtctagctctgttgcccagtctggagtgcagtggctcaatcaaagcacactgcagccttgatctcctgagctcaaaaaatcctcccacatcagcttcacaagtagctgggattacagctatgcaccaccatgcccagctaattaaatttttttttttttttggtagcgatgaggtcttgctatgttgatcaggctggcactttggtaggctgaggtaggaggattatttgaggccaggagcttgaaaccagcctgggcaacatagtgggatcctgtctctaaaaaagtaaataaataaaacaaaaaattagccaggtgtggtgggatgtgcctgttgtcctaactactctggaggctgaggaaggaggatagcttgagcacaggaggtcaaggctgcagtgagctgtcgtcacaccattgcactccagcctgggtgacagaggcgacagagtg

SEQ ID NO: 263988 - DNA, 684 bp, Homo sapiens
ctgataggacccacctgcagtcaaaatttttcacaaaggcatcaggcatcaaccagtcagaatcatgggcagtgcaagaaggtcctggagacattccagccctgcccaggcatggtaggaccataggaaggaggattccagggacactcaggaaatctcacatagtactgcagtggtgtatggtactggctaaatattggcctacatgctacctactttttaatccacactcccaccccttgcaaataaaactgtattattactgtttttacagtcctttattatttatatttatagaagtgtttcaaattcttgaatcttattacttctttatagatttaatttcctttcttaccaaaataaggttattctttagtaattttttcaagtaggactggcaaattcttcatttttgcttaaaagtgacatttcatttttactcttgaatgacagttgggctgagtagagaagtctagatttactatgatttccaataggtagtttcaaatatgatataaataccatatttcatccaatttaagaggccatcaattaattttgccatgagaaaaagagccaccaattaggctatgacaaaccaacaattttaggatgtatttcaattccagagaaaagtttacaagtaataaaagtaaatatgagagtaatgtattttactacgtg

SEQ ID NO: 263989 - DNA, 145 bp, Homo sapiens
tctcagaggaacagctgttggtgtttgcagccatacatgtttgagataagttatcttttgacatcatgaccaagcttttttgttatgtcagatgagataaaagtaagtatttgctgctaaagtttcccctgataagcagtattcc

SEQ ID NO: 263990 - DNA, 280 bp, Homo sapiens
aactgtcacagaatggaggagactaaggacacataacaattaaatgtaatgtatgatcctggaccagaaaaaggacatcaatgggaaaacttggaaattcaagtaagatctatagaatagtctgttttattggctcaatgttaatttcctcctttcaattattatactatgtttttgtaagatgttaacagtaagggacactgggttaaaggaatgctctatttttgcaacatatttgtttacttaaaattatttcaaaacaagaatgaaaaaaaataac

SEQ ID NO: 263991 - DNA, 425 bp, Homo sapiens
cagggatgctgtaccaatcaggcaacactgacctcttgtttccacagcttgaatgcattttctcacaaagttgaaccctgcttcattcaaatacactgaaaataagagagaaatcgcattaggtgtttacgctgaactcacattcccccttcagttggctctgttcactgggcctttatgactcaacagtagagaggttttttctgagtcttccaaatattttggttagaggctgactttttattttggggtagaagtagaggagggaacttcaccctcacagctattgtatcaacctgctaagatccttcacagaaagtatattacaatgatctcatccacttttcctaaaaatagcattactcctttactacgtgttttctttcagatgataggagcaaatgcagtaagaataaatccttatt

SEQ ID NO: 263992 - DNA, 506 bp, Homo sapiens
cagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctcctttgcctcatgtagtcatcactttccta

SEQ ID NO: 263993 - DNA, 451 bp, Homo sapiens
atgctagaaatagggctatatgtttctttattcctcttatgaaataaaatatagtcctagtgtcactattagtaaaggaagcattttaatatttaataatgtgcttctgtacaattcaggatttattgttaaatttggttttctacaaatattttttatctttgacattattgagaaatgagactttcttaaagcgtattttatttcactttttaaataattactaaaatattactttatatttggctctatattaaatggtaataattgtaccagtaatcctaaggagtaccctgaagtctttggctgagtgctgatctgcacatgtgtggagcaaaacttcgtaagaaaaggaccatcagagagtagaagacacaacaacaggatggcaaaaattcgcatttctgatagccagaatgataaaccttctgtcagaagacaaaattataat

SEQ ID NO: 263994 - DNA, 523 bp, Homo sapiens
gcccaagtggaacaaccagacagggtgacgaaaaccatctgcagtaaaacacgaaggaagaaaaagattcacatctatatctaaaattaaagtgtttctacatctgataaagaagttaaaatttcaaattgaatgagagaaaaaaataactaaaaaaggaaattaaaatatttcatactgatggcttttttcccctttgaaataggaaacaaggttttctactgagaataaatggggagaaaagtcagagatttaagaaaaaccaaacctgaaatagtcattgcaaaggaggaaaaagagtggactacagaaatgtaccatgaatcctatgtagtgctgaggacctgtgacctcgaatttagagaggtatcagcctgtctgatgcccgactcttctccagcacaaaaaagattatgctaactggaagaaaacagaagagtcaatggaccagaaactccaataaggtcaaggaagaattgaactgagagtaacggagacagaccacagaccactagagaaaaaa

SEQ ID NO: 263995 - DNA, 415 bp, Homo sapiens
tcagatccggactggaacctataccatcagctgtttggctccagacattcaaactacactgcgggactttcctgggtctccagtttgcaaacagataatgggactgttcacactacataatcatttaaatatgcagactgttcaatgccatcctccagacctactgattcagaatctgagatctgaagtgcaggaatcagcattgttgaacaaatccttcaagaactaaggttaaaccatgaccactcctcgaggccttccctggagattcgggctcatagattccttctttctctgaattctaaagtacttatggaagattcagcagataatttttaatgaattaaattttaatacatcaaattacttaataataaaatttaataaaattttcagtattctcaaagttgttaca

SEQ ID NO: 263996 - DNA, 927 bp, Homo sapiens
tgcctcgccctgcttcggctcgcgcacggtgcacgcacccactgacctgcgcccactgtgtggcactccctagtgagatgaacccggtacctcagatggaaatgcagaaatcacccgtcttctgcgtggctcacgctgggagctgtagaccggagctgttcctattcggccatcttggctcctggatctctgtgtcaaccttcttttatttttaaaagatattcactgtctcttactaaagcttcctgttcaaagtctggctgagaatttttgctgcttctttccctacctcctcatttccgaaggctggagtgcagtggcatgatctgggctcactgcaaccttcgcgtcctgggttcaagcgattctctcgcctcagcctcctgagtagcgggaactacagaatcagctaccctgctgatctggaggcctttggggacatgaactcttgtagcaggaatcaaagaactggtgtaagaaaacgaatagcagagccatagtgttttatcccctctctgcactccccaaattagactgcttgtttattgaaattggtcaaacagtttaattagcattccatgtttgttatttctttaatcgaggtttcaaacagaacaaggcaacaagccaggccagtaatgagtctcctccacctactcttaagttaaatacttgctgagattcccattggtttcccagagacatctcatcactgatgtactttcacttatcaacagggttattgagcactgttcataaatgcgtactaattggcagtaggcgatgtatatatttatgtaaatttacagttatatataggtacccataaaacctgtgtttttttaagtgagagaaattaagtatttttctgatggaatttgagaaattatgagggccctctatgaggaaaaatgattcacaagatat

SEQ ID NO: 263997 - DNA, 497 bp, Homo sapiens
tgcctcgccctgcttcggctcgcgcacggtgcacgcacccactgacctgcgcccactgtgtggcactccctagtgagatgaacccggtacctcagatggaaatgcagaaatcacccgtcttctgcgtggctcacgctgggagctgtagaccggagctgttcctattcggccatcttggctcctggatctctgtgtcaaccttcttttatttttaaaagatattcactgtctcttactaaagcttcctgttcaaagtctggctgagaatttttgctgcttctttccctacctcctcatttccgaagaactaaggttaaaccatgaccactcctcgaggccttccctggagattcgggctcatagattccttctttctctgaattctaaagtacttatggaagattcagcagataatttttaatgaattaaattttaatacatcaaattacttaataataaaatttaataaaattttcagtattctcaaagttgttaca

SEQ ID NO: 263998 - DNA, 492 bp, Homo sapiens
catcttcctatttttgtttgggtccaaaaaccttccctctaatacccttgtagagaagccgttttgattcctgtttttaatgtacgtaggggtccctgccacccgtggggcttctgcggtgtttacattgtcagtactgaagccccagaggggcgtgccttccaaccaacacgctgactgctggggaggcccctcatgttaccaacagtgcctcatcccctgcattgctgccaattggcatctgtcacattgggagttgcctgtgtgggaatctacaagtaggttccaagacattcacctctggcaacaaaagagtgggtggagaagtttcatttcaagtctgactcgctgttcctcctgccactcccttttttgaaaggcgagcgggtgggtggcccatggagaccttctggcagaagttcccttaaattcctgggactttgcttgccacctggtaggataaagttcaagcctgaatgttttgcctgggag

SEQ ID NO: 263999 - DNA, 2258 bp, Homo sapiens
acccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaattaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaaaaagttgt

SEQ ID NO: 264000 - DNA, 2101 bp, Homo sapiens
acccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaattaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaaaaagttgt

SEQ ID NO: 264001 - DNA, 1751 bp, Homo sapiens
acccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaattaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgaggtagtatttttgtttttgactctttgtcacacagattctctaacctctcgaattagcacctctctcccacaatgtgacaaatgtaatagccatttacgttaccctaacctgacagtgccactgggagcaagaaaacattaaaactgggggagacattgacactgctttggattagacatgactgaagtctggaatcaaatattggtgatttgtgattttacaccaagaacataagaacaggctgccttacttaccatccattcatccctctactcacccatctactcaatcagcaaatgttattttaaaataaatcaatgaattttattgggcacctactacat

SEQ ID NO: 264002 - DNA, 343 bp, Homo sapiens
ctgtacagaagctggtctgatggccttaagagaacgtagaatgaaagtaaccaatgcgcttcttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgctccccaataaagcgtgctctttca

SEQ ID NO: 264003 - DNA, 245 bp, Homo sapiens
ttaagaaacaattctcttgaatcgatctctattatgcccattctctgtccctttttcatgtctaattgtaatcaatttaaatataaacctgaaagttgtctaggtagtctccaaatcaaatgagaatgtgtattcacattagtaactctgccgcttaatatagtatttacttctgtaggagcttagtgtgtgtattaagatgtgacagataccgcctgggcaacacagtcagaccctgtctctac

SEQ ID NO: 264004 - DNA, 410 bp, Homo sapiens
ctctaggattaacgaagggtgcagtcaagcatgtgtgtgaatgtgataaatagaggtaataatagaaacatcctgaatagtgcttacagtgtatggcatcccaggcactggtccacatgctttatatgcgctcactcgtttcatctgcccaacagcctcataaggcaggtgccagtattaccattttacttgaggctaggggctgagaaaggcttagcaactgcccaagtggcagtaggtgggggtaggtgggggcaggcagtgtggccgcagatctgccctgttgtgtttgctgctgtggagccggttcagcccgggaagctggaatgcacacttgagaaccaagtgtgtttcccttcatgatcgcgcctttggggctgggtgtgctggctcgggaccagtacaggcag

SEQ ID NO: 264005 - DNA, 286 bp, Homo sapiens
ccttcctcattctgtctcgggagctccttaatgcagtcaaccgcctttcccgagattcaaaaagaagttttgtgtttccccgggggcagccgcctaatgcttcccttgttttccggaacaaagcagacattcagtgaggagggggcaggcgctgactccctcccctccccgcagcaccccgcactcctgcagattcagaacgctggctccggggcccgggtggcctgggggtggggtggggacccccttcccctaggcttggccacaaaagcctcgcccggtagcc

SEQ ID NO: 264006 - DNA, 480 bp, Homo sapiens
tcatcctttttaagccagcaattattcttcatacttgagaatgacttgtatctaatggatgagcttagagggagaagaaaaatagatgtagtaagtcatgctctttcagagtttctattttacccaaaggagggactgtgctgagtctgatttgtgtgtcatctgatcgcctgggcgaggaacacagagaagacaatctgttaacgccgagcaccgaccatctctgtgtcaggctccgcaggtggctctgtccttggcaatgtcactcgctttcagcctgttctattgccaggtgtgtttggcgacgtggaaaatactctctcactgtgggaagcttgggatgcagggaggaaactcggatgaactgggtggtaaaaggctaattagaacggaaccacttaaccacttagcggtagaaccatttaaatgtcaaaatactgagagaaaaatcttgcattaaaaaaaaagttgttttagatt

SEQ ID NO: 264007 - DNA, 356 bp, Homo sapiens
tatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaa

SEQ ID NO: 264008 - DNA, 675 bp, Homo sapiens
atggacttaaagaagggaacagacacaggggcctacttgagggagaaaggtggactccaggcttccagcttttgccccatcatgattcagggtcctaactggagagaaatgttccatgggacagccctggtgatcattttggatctgctgaccactgtgcccacctacaagtcccaagtacagccctaaacctcattctgtcctcctgtgtgtgatcctgagttgctcgtctgcacgaaaataagggattagaagtcatagggagcagcaggtgacctaaggcctccctgcaatggtgcagaggtggggccaggggttccttggcaagaggggaggaaatgagaggaggaaaagccatagaagaacacagaagaacagaataacatggctgttatggaggtaaagcgaaggtgtcccactgaggtgagtggaattggctggttagagcacgttaccttggcaaaatggtaaatatcagggcaatctaacatgatcacacagctgcaccataatgtctcattttacctaattctgttttaaaaaacattgactaaacattgtcattgggctgacaacagtggctcacacctgtaatttcagcaggcaggtggatagcttgagcccaagagcttgagaccagcctgggaaatatggtgaaactccatgtctacaaaa

SEQ ID NO: 264009 - DNA, 462 bp, Homo sapiens
tcatctacagttattccattttctttcaaatgaggaaaccaaggccagaaacattgacttttctacagttgacagagctgaaactctttcaaccctattccagttacttagaggtggtaataaaaggaaatttatggttttgtggccagtattacatgttcagagtgtatccaaaattttaaaccagcagagcaagcttctgtggactcagataccctcctcccccatcctgacactagtcatattggcacaggacacagacataaatgaaaggagccacagtgtctagtctgcttatcctaagtgtaaccttatgagcttgcaaagaaacagacttacaaatcgaaggtgattgatagctggaggaatttaccttaggctaaaggaattattctaatttctgagtaaggcttttgacttaaacagtaatatattagcaggtcagctcagctttcattgagt

SEQ ID NO: 264010 - DNA, 713 bp, Homo sapiens
caaggtggtctagaggtccatttcatttcaatgagtgtgacagccgctcttcttggggcctatgggggaaaggcattggtccgtggtgggagtgaagctgctcccacaagatgcattcccaactggatcaggaagaccttcagatttaggggaggtctttgtggaagtctttagtggagtcttcccctgcccgctagatgtccggtcggttttagcccgcgttggctactggatggtccgctgtgcgggcttcttgggctcctgcttctcttccctgggcttggagcttcgcctcttgtccttccctgacctcggcgtggtgtcttccttcacggcctgtcctcgcccctcgtctgccgctgtcgctcccgcttcctccttggctctggcacacggcggctccttggctctcggccttgccctcctggtcctcctcgccctggcattggccttggctttcgccctcgcgttccgtctccacacttctctggccttcctggccgccttgcgaaggggctggcggcgcctccgggagctccggggcgcggctggggtcctccagggagcgcgcgtgccctcctcttgcctcgcgcgtcccggctttctcctgggcttgggaaccttccagaccctgaagtagccggcggcgtcgctgccgctgacccggaggagcgtggccttggcctgccccctgggcgcttcgtggcggccgc

SEQ ID NO: 264011 - DNA, 226 bp, Homo sapiens
gccaaatttcacagacacaccagaaccccttccggtctccttgccctctgactgcatcctctggtgatactgagctctggaaggaactcgtagaaagaatttgtctggtggaacagaagacttcccaaggcatctaagcgtcagccctcccctgcacactctctcccacctcctccccttcctctcctgatttctaagcacatactcaggtaaagcaaaagcaaaa

SEQ ID NO: 264012 - DNA, 404 bp, Homo sapiens
cgcttgtctgattccaactctacttcatgacatcatctcataatattgcttttaaatagttattttttacatttctattttgcttttatcacacttgctaattgattaatctgtttctcattttctgaactcagcagagcaatctgattagcctagtgtaattttttgagctgtgaatggaccaacttggatcaagaggccatggagtttaatcatccatttacatactgggaatgttcgtgagttccaagattatgtgggtctggcaggcaattatggcttatttctcagatcatcaaccagtatccatgctcagagtgttgattcaaatagcagctgataagcataggagcatttataaaattggaaaaattttaaataaagatagttctgttagaccaaaa

SEQ ID NO: 264013 - DNA, 1097 bp, Homo sapiens
tagtgattagaaaccagtggtatataacaaggttattaatacctcatgaccaagtgtggttaatccctggcaggctttttcaacatttgaaaagcagtcagtgtaattccctgtatctcggccaacttcatggctaggtgacctgtgcagtcacacgttgctacactcttgtaagaagggatcctgtacttcacttaatgccctgctgttgccatcttgaagttcttcacagttttatctttgaactcgtgatttgtatgtgaagtctgatggacactggactatgtgtgcaagtagacaggatacttgagaggcagtgccctactaagctgttggtctgtgtagtatggcctgggagtgttctggaattgtgtgtgggtggccaaggccatgacctttgtctgcattggttgcagcagcagcaaactcatgaacatttgcaacccagagaggacccacagcgtgaggctggtttgtctctcccctaagtctgtccctctgccattcttaggaaatactaattttctgggctgagtactgggacagtaacctccagctttcaggcagtcatcatggtcagtaaagtattagaaaataaaagcatacttgtggacattgtgttaaggcacactaggcagttactagaattctttggagtgtagattctctggtgttaagaactgctgcaacattgcaaagcaaatatccacaggcttagaaataggaatttcatttgatgggagagaacattattttcatttaaaattttggatgaatcaagtattaacaaagaagtcaactttaaaaatagggttttttttgcatttgaaaatacagcaatatactgcataaacaggtgtttccaattatatgcaaatcatgaagccatttttggtttcttgtacaagatgtaggaaatgtcagaggaaacattaaaatgccattgtataaatttatatgtaaaattgaattcagttttgtacaaaactaacattcatgaagaattaattgcagagaagtgctactccagtctttgtctatatataccaaaacttgtatttttttaacttttattgtgcagtaatatatcagaaatc

SEQ ID NO: 264014 - DNA, 451 bp, Homo sapiens
ctgatagtattttaataacagttaaaatgattactcctcacctcaatgtgaaaaagtttttaagtttaatgtatggttatatgcaatttttaaaatgtatttatatatatgctaaaatattccccaaagggacatcatttagaaaaaaacaagtaaatccatttaggaacatgtgtttttcaaagtgatgtctacataataacctatcaattagcaagctactttattttaatattattactcattgcaggcagttcttaggtgcaaagcaaatttggagaaacggtttctaagcaccatcaccaacaatgtcagcaataagtagattttgaagtttgttcacttccacaaagtccaaagttctgtaagttaaacagtgggtttccaagggtgcttatcagtgtggtttaacaaggtatggtgatactgacatgggcagtgcttttggaaa

SEQ ID NO: 264015 - DNA, 802 bp, Homo sapiens
actcggggggggcggccggtgagtgaggcttacagggccccgggaccaaggttcataggtggaagaaattcatctccagatgagactttggacttggacttgggacttttgagttaatgctagaatgaggaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaagtacacaccttattgaacatcaaagaactcacactggagag

SEQ ID NO: 264016 - DNA, 1412 bp, Homo sapiens
ccagaacacactcgctcttgagctggtctatttcttatctctcttcaggcaaagtcgtatcctccaccttacctgctccagccgctgtgacatcacgcaggttccgttccctgcactaccgctggttatgtttccttagtgaccctaggcctcttgcaggagagtccctggtcccagccagcgggagcggcttctccagtttgtggctctcggagagttcgcctcgtccctccctctcagataaccacctatttctgacctctggaggccgggctgagcccggaattttatgaccagcgcccgctggccgtcgtcaccctctaatttctcgcaaaactcccggggacccttcttaatgtcagtagccacagtcgccgccgctcctgcgcctagaagccttccacgaccctcaaccccacagagccccgagcaggctcgggttcccgcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggttcataggtggaagaaattcatctccagatgagactttggacttggacttgggacttttgagttaatgctagaatgaggaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaagtacacaccttattgaacatcaaagaactcacactggagag

SEQ ID NO: 264017 - DNA, 743 bp, Homo sapiens
ccagaacacactcgctcttgagctggtctatttcttatctctcttcaggcaaagtcgtatcctccaccttacctgctccagccgctgtgacatcacgcaggttccgttccctgcactaccgctggttatgtttccttagtgaccctaggcctcttgcaggagagtccctggtcccagccagcgggagcggcttctccagtttgtggctctcggagagttcgcctcgtccctccctctcagataaccacctatttctgacctctggaggccgggctgagcccggaattttatgaccagcgcccgctggccgtcgtcaccctctaatttctcgcaaaactcccggggacccttcttaatgtcagtagccacagtcgccgccgctcctgcgcctagaagccttccacgaccctcaaccccacagagccccgagcaggctcgggttcccgcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggtaagacgtgcaactgacactcagcgcgcggaggagcccgctgagaaagggtttacctgtccgaagagaactgcgcttccgct

SEQ ID NO: 264018 - DNA, 337 bp, Homo sapiens
agattttgtatggtcatatgcaatagttctgaactcttgtcttcttatgcacaatgttagggttgtgcatgggttggttttcttgcacagctctcattagatttatttcagttacctattcacagccctaatggtagtgacatccctgtttatttacttcttggattcttaccaagttacaacatgatctctttatccttgggctgctgattctattaagtttactatttcttttatttatttacttatttttttgagacagagtctagctctgttgcccggagttgcagtgagccaagattctccagcctgggtgacagagcgaaactccatcttt

SEQ ID NO: 264019 - DNA, 730 bp, Homo sapiens
agacccgtgatcccgtcagccacccagtctgagatgctgacgttatcttcgactattcttccctgtcctgccttgctaattcttcccactagcactaatctcgactctttgtcacttggactatttcagcaacagtctcatctcccagattacctctgtgcacactgacacgtggtcccgtccatcctgaacatgcacagtgattttcctctcccgttgcacacaaacctttaaaagttccccggcccgtgaacaaatgtacaattctctattctgacattacagaccaccggataaggccccattcttcctttacaccctcccctggtcagcctaggagagttgtttttcctggaaagggtgcctgcgttttactgtctctgtgcctttggtcttgctatccccatcccctggaatgctcccttttcttcccttcaaagcccatgcggaaaccacgtccttcatgaagccctccctgatgtaccaaccactgggatctctccctctgctgaaccaccgtagcactttatttgtacctttctcatggcacttaccatattctgccttgtattatagttatttgtgcacttgtcctttgactgttcttagactgtaagcttgccaagggcagggactgtgttttattcatctgtatccatcacagcactaggcgtggtgcatagcacacagcagttgctcaataaatgtttgttggattaaatccttaaaa

SEQ ID NO: 264020 - DNA, 376 bp, Homo sapiens
gatgctactggcccaaggagaatgtagaaacctgtggtgtcaacttgaacccaactttactacgtagtgaagcccagctccttccagtcaagtccgaggagccatagttggtcacccatgagtaagaaaatgagcggcagctgccataagccaagaaaaatatggttggtgtaagacactgagagctttgaagttgattaatcaaaattaactaatactctacacatttatgatacatacaccatgagaaaattcatcaaaacaaattttatgctaatgaaaaataataataacaaaaaaggaatcagtgggaaagttaggattccacacactggaacttcacctgctcaaataaagtagtcatatatctatctgt

SEQ ID NO: 264021 - DNA, 397 bp, Homo sapiens
cattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacaggaagaaaacatagatgctcataatacttcggttgcactgggcgatacgtcc

SEQ ID NO: 264022 - DNA, 531 bp, Homo sapiens
cattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttgtaagtatatggataaacatttattataacattttcactgtttctgatctttctaagattactgtgtatatgttggtcagccacatcagatcccttctggactatcactgtattctggaagcacttcacttgtttttataggacccaaggttttagttagccagtcttaatcattgtagaatgagccaagccatttccttaagcaaagccaatgagtgagaatagcatttgtatactaccgtgtagaccc

SEQ ID NO: 264023 - DNA, 529 bp, Homo sapiens
ccaacagccagttagctatatgatcttagaaattcagtttatttctctggcctaaatctcctcatttacaaagtgagaagatcagaccagataatttctaatgtttctcattacaattctaattcaaaactcattgaggaagagaagccaacttccttgatatttctttacacatcaatcaatgttaggatcacaggaataagtgacattaaaagggtcacctacctgaatattttaaagaatgctacaaagaaaaatatgtcatttgcttgtaaaactgtgctatctagagaataatgataaaaaaaaaaaagaaataacaacgaacaggctcagggcaattacaacatctctactatccagcactgagtctggcataccctacaggtcataaatttgtctcttggctgggcacagtggttcatgcctataatcccagcactttgagaggccaaggaaggaggattgcttgaagccaggaattcaagaccagcgtggacaacaaagcaagaccctctacaaaaacaaa

SEQ ID NO: 264024 - DNA, 845 bp, Homo sapiens
tgtagagatgagtctcactatgttgaccaggctggtcttgaactcctggcctcctaaagcactgggattacaagcatgagccaccatgcctgatccataaattgttctactgataccatttggttttgttagaatttgggggggctatagaaaacaaggttacagtcttcattagtatttctttttagcaataacaacaaaataggcaattagaccagtgttcatttggtacagtctttaaatcggtcatccaattaacctttaaaaagtaggttatgctcttaaattgtattggttctttaatatgtgttataccagagtatgcctcaaattttatgtagttgaatttgtagaacaaatttggggatattcattttatttttccttttatatgaaattgtataagtacattagcttgacttaaattataaaaaaaaatatatatgaagaagaatgtagaccctataatgttttttgtctttgactttttggcttttatgtacctcattttttctgattgagaaaaagttttgaaaaagtgattcacttgttggttttcattgtggcaaaactttaaattttaagtcatcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttat

SEQ ID NO: 264025 - DNA, 392 bp, Homo sapiens
atgtacatttttgtgttctatttcaaccagcatgcatccattttccaatgttataaaagttcctcaaaaaccttttagaggctgtgtacttccttgtataaatatagcacagtatatttaatatttaattgtttttgaatagtttatcccctgcttttttgcctgtctccagttctacagtgaaaatttttgtacataaatttttatctagttacagcttcatttttcagcctgggttcctagaagtgagattactgaatcaagacaatgataattttattatttttggtgtataataccaagtggcttttccagtaggttatctgccagtttacaaagagcacaggttttcagaaactgtagtgctcaacagagaagccgtctcttggtgt

SEQ ID NO: 264026 - DNA, 677 bp, Homo sapiens
ggaataaggcctgatctaatctggagatgttacatattacatgtgcataggtacacacacacacacacacacacacacacacatatatacacacacacatacacacacagatatatacacacatatatacacatacacacacatatatacatacacacatatacaaacatgcacacacacatatacacacagacacacacatatatacacatatatacacacagagacacacatatacacacatatgcaaacataaacatacacatgcatgcacatgtacacatacatatatacacacatgcacatacatatatgcacacagagagacatacagagacacacacacatacacacacgcatatatacagacaaacgtataagcatgagtaggagtcaggagggaccagctaaaataatacattcaaccaaacgcaaagctgttaactgccccctcctcatcaatgctacacttttatataaatatgaaccaatataaaagtttgatttactaaaacctaatggattaacattaaccaagagaaaagtgtaaatggagtaatgcaaattagcatgtttgaatgggactccttcattttggggcttttttgaggttgggacacattcattcatcccatagagtgtgtaatatatacaagcctctaagttaggccttgggg

SEQ ID NO: 264027 - DNA, 419 bp, Homo sapiens
ttaaaaaattgaatgaattgccatatttaaaagccgggaaatgtggactctctggcttcttttaaaaaaccagaatatctacccacttaaggccacacccttatacacaacaagaggttggagctgaggggcagatgcctgctgtatttgtatacagccttgagttcaccgcattccccactactcactgatgtcttacccccagcccgcttcataccatctgtgttgccagcctgattttgagtctgtgtcccatgtttatgtcccacagaccttgcttgtttgtttgaacattatgagctgtgtcaacttggcaagtcacttaaactttattccttgatcgctctacctcccaattcttatctccagccattgttcattaggttttgctatttccaaatttcgttgacttcaggcag

SEQ ID NO: 264028 - DNA, 528 bp, Homo sapiens
cagtgaagtggatcattcttcatttgtgcttaagcctcgtggtcctaaaagtacagagacatcagacatggtattcatttaaggatagatttttatctacttcttgtctaaaagagcacagcatttaaatatatcactataaaactagtgatcactagtttttaataaatgaaggcagagtaaaaagtaaggacattaagcctcatatcaattacagccttggaaggtaaaaagtcaggactgctagctcgctggtcaaattattatggagaggtgcatctctgcatctgtgaacggttcaccactcacaagttagatgcttgttcaaagagtgttttgatggcaattctgtaaatcaagggcctttaaaaatgcagatagcaggtgaggtgcagtggctcacacctgtaatcccagtgcttttggtaggtcaaggcttgaggccaggcgttcaaggatacagtgagctataatcacacatctgcactccagcctggctgatagagtgagacccttgtctcaaaaaaa

SEQ ID NO: 264029 - DNA, 955 bp, Homo sapiens
tggagaatagacgtaaggactctgtatttcacagttttctataccatgaatattagaataactgacagatgtcttgccattgatagttgtaaagacttttcatatgtacaatgatccattatttcctgactacaaaacccaggggtatataggtcagattatctccattattcaaatgaggaattgaagctcagaaaggtcaagtgactagcgcaaggtcacacagccagtgagggcaagtgcaaacccagccagcctaactcctaatcttctcttttaattccattacataatgacacctctcatttgcttcagaaatccctgttgtaaagatagatgcaactagcatgatccgtgttgttaggaaaggcatgtgattaattttaaatagatatagtatttaacaccaccagatgagtctccctctgaaaaagcacacaaaaacaaaacaaaacgctgacatagtttccgcaagtcacgaggcaattatgctaattagcaacaagcctccatccctaagcagaatagttcttgtgtgaaacatatcatttaatctttataaccctgatgtgacctagatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacat

SEQ ID NO: 264030 - DNA, 438 bp, Homo sapiens
tgcagctgttctcttagttacattggcagattgtgtgttgtcaatgttgactattgcttagggaaccacagtatatcagtgcatggcctctgcctggccctttcgcacaattgtaactgtagcagtctgcaaagatatgaaaggaacatctgtgagatagatactgaagactgcaaatctgcgtcctgcaaaaatggaacaactagtacacatttaaggggatatttcttccgcaagtgtgtcccaggatttaaagaatttgtcagtgtggccatctcgtcttgtgttttctttttggggaggttttgactacgaattcaatcactttacctatggatcaacaggtacccagagtatgctcttctcatgacaaatggcaaaatcccaatgagtgaaaatatttgatgtctaataaagcctcagcttacaactggtaaa

SEQ ID NO: 264031 - DNA, 486 bp, Homo sapiens
ctgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaaga

SEQ ID NO: 264032 - DNA, 449 bp, Homo sapiens
agaaataacttaagggcacataaatgtttggcatatgatttatttcctatttaaatataaatagactcaacatgctaattttgtgacaaaagtgactgccccaaaaaaataaataaaaggcagtcccttttcatcttttctatgtattctatgtattactcctctcagaatttaatggaaaaatttgcagtatgtcttaacacaacctttaagagaaatgtaacctggtttctcattgctacttttgcttgccttctttcgagaattatttatctaatatgaattatttttgaaatcatttagtacctattaagtacaacgtgtcatctgtgacattaacatttcctttatctttcatggttttcatccaggatagtattatttttctgtctttttctttataagcttttggaaaaataaatatgaatttaatatctaagaaagtttca

SEQ ID NO: 264033 - DNA, 465 bp, Homo sapiens
aatatctcaggatttgcagagactttgcttttacctcttctttcattgtagcttggtcattctcaaatttgagtttctaaggacttttaaagtgttacgtatgctaatccatgtatacattatttttatgattgattaaggacttttttgggaagagttgtggctatacatgatttttacctaatctaatcattttagattcaaactccttgcataaaatgtagctctgcttagcactgctgccattagcttatttctgctggcttagagtgacgtctcggctagttcctgtgttaagataatttaactggtttacattttcttttttatgatgtgtgagttctttctgtctttctcatctttacctttgacatgtcagagacactgttgcttagttattaagaacagactgtcagccgggcgcagtggctcatgcttgtaatcccagcactttgggagcccgag

SEQ ID NO: 264034 - DNA, 351 bp, Homo sapiens
tttgaattaaaaattacccattaaatgccacatggcccagaatcaactgatggagaacattcaaggaatttatttattgagaaaatgttgtgaatacttttaggttacatggtttcccattctagtgtccaaataaaaattagattctcaagtcttcacagtagaaatctgggtacttcagatcagacatcttaagcataaagacatcttgctttacttatcttaaaatgctgcactacagtcccttcttagagaacttaaacatgaagtcacagcaatataatactgctcaagcatttacaatggctttatttgaagaactaatggatatattagcaatctagtctagat

SEQ ID NO: 264035 - DNA, 396 bp, Homo sapiens
gtttagtaaaccacggatttctagccaagctggctctttttgataccactgtctttggatgtttttatgccacaatgacagaattgagaggttgtgacagagacagtgtggcatgcagagtttaaaatgtttactacttggccccttacggaaagtgtaccaacccctgctctagaatgagctgtggattttttttttaaatctagttaaaaggcaggcataaaactgggaaagttttacaaatcaaagcacttcttttgtagtggcagggggattttaaggcatgaaaaatggagtcatctttctggttctaggaggtgtttttcatgacatgctttttttcctttgattcaagtattttcagatgaatcagttagtaaaactagaacagccagt

SEQ ID NO: 264036 - DNA, 353 bp, Homo sapiens
acacagcactccaccctacctacctacccgctccttacagggaagacagtgcaagtgcctgagaaacactgtgccatccaaacataaatgctatttatggcatcagttccagaaactcaaccccaaaggattagactggttctgcccatgaggagtgcagggggctgtagtggggtctgaaaagcaacaaaggatccccttgactaggctcagagtctccagacactagaatcactcttcagaatggaaataccagttacaaggcaagtgctgcccaacaggaagcaggagacgttagctcctggcaacaggggaacatggagaaggacagacacatctttctttatagtaaa

SEQ ID NO: 264037 - DNA, 1036 bp, Homo sapiens
gccagataattctttggtttgtggggctatcctgtgcattttagcagcatccttggcttctatctgctagctgccaggagcatcccttcatcgtgacgagcaaaaatatctccagacattgccaaatgtcccccaagaagacaaaatcactcctagttgagaaccagtggtctagaaagaaacattcatattttttctctgcaaggtgggactggcaggatgggggcctgggggaggtagatttaaaaaatggatatctcagtctgtcttctaagtttatataagccttacaattctgcgggtgttaatgtagttccattaattgtaataactaatatttaattggttcttgccccctctcattcagacaagacctccaccctctgcaaaacatcttcccaggattatgggaagtgcccaagatgtggtcacgggtgtaccacagccagttggcttctgtggtactctgccgctgcgcctgcctccacttctgtggttcatccccaactcccatggaagttggagcactttcacggaaccctgcggttctttccaacatgcagcagccaccagccacagtcacctgcaaccacaaatcagcaaagccccacagccccgaatctccactgaggtttgtaatgaagtgggacttcaagtttaagtctttctccgaggctattacggcctgccagtaggggctctccatgtgcactgctcaaaccattatgctctataactgttttcagtgtaaggctctttacgctttgttagtaatctcttgctctccggagcccagagagtgacagattcgtaacagacccctgttcactcctcgttgcctctcccctgtgctgagagggcttctcattggctcaggtgcatcccctgtgctgcttctcccctcaggatgccctcttcatctagaggtttctccagggaacctgcctggctcactcacctaacaagctaagaaatgtctgaaccgtctttaaattcaagccaggagcctagaagtagtcctagggaaaacgaaaca

SEQ ID NO: 264038 - DNA, 586 bp, Homo sapiens
cctaaggcagcaatggctgctgtaatgaactgatgtgaagaaatgagaaataaaatggtaaaatggggtgagcagaaattatattgtgaatgacattggaaactgaagatcccaaatatggtagattcttatgccaagtgcttaaggataatcctcaagtcagaataccaagcagctattatatgttaaatcataagaatatgctgctgagctagaaaggcatggtccttgtcttaattgagctttaacagcagaaaagcaataaatgtataaatgaatatagaactctaagggattttccagatgttttagtcaaaataaatggattatcacctgaggcttggaaatcttacatggtaatatttatttagtgagactttgcctttactgcagagtagaagcaatcttccctttagaaataaattctgaaagtttacctgtaattttgatatttgaaatttaggttatgttttatagaaactatgtgataaattgattaggtggccaggttagtccacatgtgccaatgtaatcaactgtataccggaagtataatactaatgtaagtaagtaccaaaccctgggt

SEQ ID NO: 264039 - DNA, 126 bp, Homo sapiens
tgttttcaatgaaaaattgccaagccctttggaggccctgatggctcaaccaggttggtggctgctaacgagagtgaagatctatattcagtccatctggcacatgtgcagaagacccttctccaa

SEQ ID NO: 264040 - DNA, 4279 bp, Homo sapiens
gtctgaaggacctgaggcattttgtgacgaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtattcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaagtcagagaacttctgagggttttgcacagtctcctctccagattcctgtgagctcctcctcgtcctccactttactgagtcttttccagagttcccctgagagaactcagagtacttttgagggttttccccagtctccactccagattcctgtgagccgctccttctcctccactttattgagtattttccagagttcccctgagagaactcagagtacttttgagggttttgcccagtctcctctccagattcctgtgagctcctcctcctcctccactttattgagtcttttccagagttcccctgagagaactcagagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactcatttatttga

SEQ ID NO: 264041 - DNA, 4100 bp, Homo sapiens
gtctgaaggacctgaggcattttgtgacgaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtattcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaagtcagagaacttctgagggttttgcacagtctcctctccagattcctgtgagctcctcctcgtcctccactttactgagtcttttccagagttcccctgagagaactcagagtacttttgagggttttccccagtctccactccagattcctgtgagccgctccttctcctccactttattgagtattttccagagttcccctgagagaactcagagtacttttgagggttttgcccagtctcctctccagattcctgtgagctcctcctcctcctccactttattgagtcttttccagagttcccctgagagaactcagagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagaagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactcatttatttga

SEQ ID NO: 264042 - DNA, 3311 bp, Homo sapiens
gtctgaaggacctgaggcattttgtgacgaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtattcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaagtcagagaacttctgagggttttgcacagtctcctctccagattcctgtgagctcctcctcgtcctccactttactgagtcttttccagagttcccctgagagaactcagagtacttttgagggttttccccagtctccactccagattcctgtgagccgctccttctcctccactttattgagtattttccagagttcccctgagagaactcagagtacttttgagggttttgcccagtctcctctccagattcctgtgagctcctcctcctcctccactttattgagtcttttccagagttcccctgagagaactcagagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagaagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagaactcagagtactttgagggttttccccagtctcttctccagattcctatgacctcctccttctcctctactttattgagtattttccagagttctcctgagagtgctcaaagtactttgagggttttccccagtctcctctccagattcctgggagcccctccgtttctcctccagctttactgagtcttttccagagttcccctgagagaactcacagtactttgagggttttccccagtctcctctccagattcctatgacctcctccttctcctctactttattgagtatttcacagagttctcctgagagtgctcaaagtgcttttgagggttttcccccagtctcctctccagattcctgtgagctcctctttctcctacacttattgaagtcttttccagagctgccctgaaagaactcaccagcaatttagaagggttgcccaagtctctcttccagattctggtagttctcgtccgtctacgacaattatcgggctttcaagaagtccctgagtgtctccaaggaatttgggggttcccaggttccttcaaagtctaagcctgaggcacatgccagctcctcacagccagaattccgcggggccggccacaatttgagcctcgggggccatcatcatatcagccacggagacgtatccatccgcaggggccgctcacaccagtcaggcatcacacgagat

SEQ ID NO: 264043 - DNA, 408 bp, Homo sapiens
gtggagaacgaagccactgggaccgtccggggagtggagtaagctcctccgaagtctttctggagagactcggcctgggcgggggaactccgcccacccaacccttggcaacccttggatattggcagttataccaataaccaaggtcctggtctacacctgtcccccccaacccccttccccgcgtccaagaccactgatacctgcaaggaaagccggaaattgtatgtgaatcacctaaatgaactccagttgccagctgatttgagccgctaaattcccaggctcttccatatctctccagagaacccatctacaagtaggaaaagctatcgttttcataccctaaaaatgaaacactgtggtaattctgacagaaaataaagacctctgaaggtgaactttgta

SEQ ID NO: 264044 - DNA, 627 bp, Homo sapiens
gtcatcaaattagctgaatgaacctggacctgtttgagctacctagaataacgtgaactaatcccagatatattattcttgattcacaaatttcttctgtgatagaaaaaagagtgagaggtggccttcagaattagcagtagtggaatgattcaggggcagggccccaggattttttaatgatcaatcaactactcattgtggcaagaaccattaagtccctgagggagataaatgcctagaagtgaggcaaaaggaaattctaactagctgagggttttggccccaaacatctaggtggtctcttgagaactggactaggccacaataagtcacaaagctcttgcttaaaagtaatgtaactgctaatttgcctctcttggaggttagtatttcttaatagtactcagatgtattggctgtggagaagggaatgtgccatgtaaaatacatttttcaggacttgaatctcagaaaaaccaattcagaagatgtgagatgggtttcaagaattatttagcagtgcctcagggttctctgaggtagatggttagtgcattagactatagcctccgagattttggtgctgcagtgatatagaaaaaaaaacaaaagaaagagcacaat

SEQ ID NO: 264045 - DNA, 208 bp, Homo sapiens
gttttatgtgtaataggagaaggatttctgcttataatagttgtaaaattagggatgggtatacttttttcagtgaaataaatgccttacttatttcttttactccaaatgtgtttttatgcctctttcatttgtatgcctatgaatgtatgagtctgtgaaatgattccattaaaatagaaatatttagttatttgaactaatatat

SEQ ID NO: 264046 - DNA, 448 bp, Homo sapiens
ttagatttggataccagctaacattgagttcttactacattgcaggctctgttctagtgcttcacaagtattaactcgtttgttcctcccaacaactatgaagtaggtactattactgttcccactttacaggtgatttgaccaaggtggaggcaggatttgaacacaggtggtctaagattttagccactcttctctgctgcatccctggacgtagtaatgatggagcaaaggaatgtccaggacacagaaaactcaggaggccacgtagaatccagcatgtctaaagtggtgtatgctcactgcagaaagtgtgtgtaggtgggataggacaggcaggaggtgttaaaggaatgataaatggaaagaataaaggatatgttgtgggtgagtttgctcaataaaaatctctacaggtcctaggtttgggttattactactccttcgg

SEQ ID NO: 264047 - DNA, 202 bp, Homo sapiens
gttgagtcaggaattgacagcagagaactcaaggttaaacctgacactccgtttgtgactcggtctgggttagattgttttccccccttaatggtaagggggtaaaagcagcttgtttttctgagaccaactacatgcatgtagtttatattatgtgcggaataaacagaattcaatacgatattttcttacaattcttatt

SEQ ID NO: 264048 - DNA, 340 bp, Homo sapiens
gtttcatgacttgccccccagagtggaacttgggtagagttagagtcagggccctggtccctggtgctctttcctggtcgcttctcatagccaggacgttgcttacattagttctcaaccccactgggaccaatcatttttattgccaatctattttggggctctgttctagtggcaataaatcattctttcagagctccctatttaaccttgtgagagcgtgtgtgtgtggtggaggtgcttacataaatgcagtatttttaacctgcctggcacgctttaggttggcgttaaatgaatatctggagaataaaggtttgtagttattctgaagcaaaaa

SEQ ID NO: 264049 - DNA, 217 bp, Homo sapiens
tgggcatggtggcgcatgactgtaatcccagctaatcgggaaactgaggcacaagaatcacttgaaccgggaggtggaggttgtggcaagctgagatcatgccacttgcactccagcctgggcgacagagggagactctaaataaataaataagtaacttacgtagtgctgttatttttatttcaaaacgtctctacctccattttgaaacaacatg

SEQ ID NO: 264050 - DNA, 623 bp, Homo sapiens
ctggatcattttacattcccaccaacaatgtatgattgatccattttctctgtatccttgccagcatttggtattgtccccatttttaattttagttgctctggtacatgtgttcagatatatcatcatggtcgtaatttacattttcctaatggttacttacgttgaacatctgctcatgtgagtatttgccattcatatatctcttcatgttgttagacattttttaattggattatgtttttaatgtcgatttctgagagtttttttatacagtatagattagacttttgttaaatatgaaatttacaaatattactttgtcttttcattttaacagggtcttttgcagagcaaaagtttgaaatattgttgtagtccactgtgtcaatatttttctgttataaattatgtttttagtgttatatcttagaactattcaccaagacccaggtcccaaagatgttatctactgtcttctaagcttaggtctaggttcagcttttgccaatagatagccaatcgctctagcaccgattgttagaaagactagccttccttcatataaatgcgtttatgcctttgttattagttggtcataattgcatagagctatttgtagg

SEQ ID NO: 264051 - DNA, 488 bp, Homo sapiens
cagtgtgaaaatatgcgactgaggaaaaactctacaggtgtagcatagacatgcctgttttctttttggcggggaggagggtggctggagtgcattggcgcgatcttggctcactgcagcctccaccttctgggttcaagcgattctcctgcctctgcctcctgagtagcagaatacagccacacaccaccacgcttggctaatttttgtatttttagtggagacagggttttgccatgttggccaggctggtctcaaactcctgaccgcaaatgatccacctacctcaacctccaacgtgctagggttagaggcatgagccactgtgtccagtcgatatgcctgttttcggaacccaggaaatcaaccttaacacacttctccatccctacctacccaagctgtccttttttctccccctacctctaccccacaacccctcaatgcagaacctccagggctccccaggactcgggatgctggaggct

SEQ ID NO: 264052 - DNA, 313 bp, Homo sapiens
cttcagtttgtaaacgtcccgacaacgcaggaacagagttaaaagagtgtgtgtcgtccttagctgctcccaccccatcgtctcctccctagccaacccagccgccagtctggcgtgcgccttcaaggtttcttcctagacactggcaaacatagatcactattttctgccacatggtatcttttaaacacacacgattgttttgtgcagaaactttctatttttacctctcataagtgtcctgtggattctttccatgtcactgtggtgtgtgtgcgtgtgtgagattcaagttcagcttgctaatcttgta

SEQ ID NO: 264053 - DNA, 584 bp, Homo sapiens
gccagcccagcttatgttctatggctgccagagttctaatttttccctgtgttggagtgcccagggggcagcacaggctacaaccctggctgttcgggcacctcagatgatccagcctgtgagccttagacagctccccgaaattggaggttgaacccaacacagcacagctgctctaccaaaactgctcgactgcttctttaaggaagtccctgatcccattccccctgactgggtgagatctcctaattggggtctccagccacctcctacaggcatgttcaggctggcaacaggtcagtacctccctggaacaaagcttccagaggaaggggcaggctgccatctttgctgttcacagcttgtactagtgatagctccaggtactggagatgactagggtccaaaacagacaccccagccaatcacagcagcactacagaaaagtggccagactgctaaaagagaaacaaacacattgtccgcgtccaccaccaaaccccttctgggttagcaccctccaagaacaaagggggatcataccaagatggccaagaatcatggcaacatgctggaacctccct

SEQ ID NO: 264054 - DNA, 2408 bp, Homo sapiens
gcgctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgattta

SEQ ID NO: 264055 - DNA, 489 bp, Homo sapiens
cagccacaaagctggctgtctgaaatgtggttaaggcaaaacactcgggggatctctttgtagtagtgggcttggctcgctttggaaaggccggatttgactcgtgctgggcatttaaccaggagtgcggtccccagggtgtttcctcccggcttctgcccaacgagcctggagttaatgcgttaatgggctaccctggtagcgcacaggccgttttcggcactgtttctccttctctgatgactcgagttcaacctcctgggctgagttgctttgcctccgtcacagtgcaaggagggaagttgacaggaggaggagacgccgcgctgtagcagggagctttgggatccaggggactggaagagagccgcgcgccagcagctggggccgctggtgtccgggattccgagttatggggacaggagttaaatagctgaactttcagcgatttcgcctcgagcgaagcggtaataaaaggcaagcttctga

SEQ ID NO: 264056 - DNA, 318 bp, Homo sapiens
gttcataccaatgttccctgaagtgtttttcatgaaaagctagcccttagatagtgtctggaaagagaagattatttggttataattatatttatactgtgctgtttaccgtaccctctatttcccaaaatctccaacaaatccagagatgtaatgtacaacataagcattagagataataaaattgtattgtgtcagggaattttgttaaataagtggattttggctgctcttgtcacagaaaagtaactgtgagataatagatatgttgatttgcttcactataacctatgtgtaccctgtaatatgttgtaaatc

SEQ ID NO: 264057 - DNA, 601 bp, Homo sapiens
gttcaccaaatgtcccttcagctaagaaaccacctaagattctttggattcacaggctttcttttaataaaaaaataaaatttaaaaggccttctgaaaaagtttttaaatgggccaaggacagcagaaattgcaactccagaaatagagagtaaagctctggactccaaatgaaagcaaccataactacctaagaataacttgcctaaaggtatatttttacgagttataataataaattattaacgactaaaatgatgagattttaaagaatatttttttatccagcaattcctaagcacatactgtagcaactacccagatatctgaaaaggacagtgacctctgagtattcccctgaactgacacctcaccactactcttgcggactctgagagtcatgttaatctgttctacagaaaggcagctgtggtgtcctagaaagtctggactggtaatcaaaaccttcggctctaattttagctctcacttagaagctgtgtgatgtgtggcacaacactaaacctctatgcaactggactttgctcatctgcaaaaatagaagccattgggataattcaacaaaacgttcaggagaaaa

SEQ ID NO: 264058 - DNA, 311 bp, Homo sapiens
agatattctttatgttaatgaattgtcttctgtagaaatgcaaagatcttttggaagggctgtacacaggtctaagattgtagctaagatattgctacccagagagattttggaagacaagtgttgaaaaagctgccatcagcctgagtccaggatgactgtgcacagaagggttgcccatcaacttagaacattcacttcaaattgtcacgtgcgtgagacatacactttttattctgcaagctgtctggaaacgtcatttgttacagtgactcagtatatccttcactaataaaacatctcatgcagaa

SEQ ID NO: 264059 - DNA, 457 bp, Homo sapiens
acatttctaaatgtcatgttggtgggtctctagagatgtgttgcctcagttatatgaagcttatttgaccccataattagtgcccaccctgtcctgctgaacttcctgtttcccatatatttatttatatgacattcacgagggtgaaatttgctttgcctcctgagatgactgtaggtctgggtgaccccaacacctgagttcaggactgatggcaagagctgcactgtctaatatggtagctactagccacatgtggctgttgggcatttgaattgtgcctactctgcactgagatgctttaagtataaaatacgcaaagtgctgggattacagacatgagccactatgcctggccgaaattctattctttcatagtaaaaatgtagtaataggagcatctattgagtaatttccctgaaacatgagaccaagccagaaatagaaaaaaaaaaaa

SEQ ID NO: 264060 - DNA, 374 bp, Homo sapiens
ctcaccatcctccaatcccagttgccttcccaaaggtaacatggttgtcaggctggcctgaatgggctcagaacattttgtgtgggcagctgcatgcctgtagggggaatggcgtttgtgtgtgtgtgggggtgtgtgtgttaatactttgcacttcattctgttaacttgctttttttactcaacattacgctttcgaaatctaccatactaatacgtagagctctagttccttttaagctgctgtatagttttctttttctttttttttcgcggggtggagcagagttttgcttttgtggccccaggctgcagtgagctgagatcaccccactgcgctccaacctgggtgacaaagcgaaactctgtctcaa

SEQ ID NO: 264061 - DNA, 355 bp, Homo sapiens
gattgcgtcactgcactccagcctgagtgcagcgggagagactccatctcaaaaaaaaaaaaaaaagaaaagaaaaagtgacaacctgcttacagagtactggcgagtttgtgggtgggtggctccctagccctgctgattcttgcttctcacactcatgtctgcccctgccccagtgcacatcttgtcactgtcggccccaccgatggggttcctactgagtcttctggtccctgatcccgtctgtggtcattttcctgccaggtagcttggccaggcctcccctggtgcagatttcatccttggtttctcagcctggccttgaatgaccctctacagcagggtccccacctct

SEQ ID NO: 264062 - DNA, 406 bp, Homo sapiens
aggtaaaataagggttacttgaacataagcactgtgataacacaacagtcagtctgataaccgagatggctaatattaatagctgactaatgagtgggttctgtggatatgctggacaaagggatgattcatgtcctgggtgggatggagaaaacaatgagagatttcatcacactactcaagatgatgtgcaattaaaaacttatgaattatttatttctggaattttatatttattattttcagatcattgttgaccatgagtaactgaaactgcaaaaagcgaaaccacagataagggggggatactgtatttactcccttgaaaagctttcttctttcacatttagtaccagaagtgatttgttctcttctgacaattgttaaatataacttatttttttaa

SEQ ID NO: 264063 - DNA, 455 bp, Homo sapiens
tggttagcatcaaagtgcattactggacttaaatagaagaatactttgtataatagtgcacaaataaggagaaaaatgagtctggctttagactctaaaataaccttcaatacaaaaaactataacaatcataattaaatgaagaaagtgggagccaaactatcctttaagtaaaaaggatgctgtcaaatattttttagccatacagcaaattatttctgtgactaaatcttgaggaaattgtggggaataaagtccaaccaactaggaatgactggagaaactattgctaaggaccgctggtgagcactgaataaatttaaccataaaactaagactaaaataaatgttcatattactgtgacagaccagaatttactttttatatatgctaataatgtacaaatgacacaaccgtaatgaattgggaggggactgagaaaagaaggaaagta

SEQ ID NO: 264064 - DNA, 273 bp, Homo sapiens
tattaacaggcccaagcataaaaagacacttgattttggacagtggtaacaccatgggacaggggaaagtatggttctttaaaaaaaagtaccaagtaaattgaatataaatagagaaaaaataaaaatggtcactctgtttcacaggatacagagaaattaagtcttcatagattataggtctaaatgtgaaaaacaaattaacaacatttcaaaaaataacatatggtcttatgataaggcaatatttctcaaacaagataaacataatgg

SEQ ID NO: 264065 - DNA, 401 bp, Homo sapiens
  misc_feature (358)..(358): n is a, c, g, or t
aagtgttgggattacaggcctgagccaccgcacctggccatctcactgtttttaattggcaactctttttatacattttccggccatttggatttcctctttgaggaagtaacttgtctaggacttttgtccatttttctattaggttatatgtctttaaaaaaaaatagagatgggaccagcctgggcaacccagggagaccccccctcgtctctacagaaacttaaaaagttagccgggcatggtggcgcactcctgtagtcgcagctgcttgggaggctgaggcaggaggatcactggagcccggaaagcggaagttgcagtgagctgaaatcgtgccactgcactccatcctgnacagcagatcaagactctgtctcaaaaaaaaaaagtaaattaa

SEQ ID NO: 264066 - DNA, 280 bp, Homo sapiens
tctacattgctcctatgagctaacaccttttacatttcagtcctttattccaaactgtcaagatcttgatgccgtcactcactgtatcaccagcgcctcccagtgcacctcaccaccagcatatatctgatatgcatacctcgtccatcccaattcaagcagtgacaaaggactaaaacatggcggatggtggcatgtcacacagccctgcctctgaccaatgaatcatttctaagaatgcattcctttattagtcaccacagtgctcacatcatcctat

SEQ ID NO: 264067 - DNA, 246 bp, Homo sapiens
tacatgaaaaaataatgatgacaatgctttaatttcatttctctgagctttaattctgtattaaggactgtgctgtgttttaaattgatgatttgatcccctcaacagtcctgaggttagtcctatagtgacatgcctccaggttccacatcccacaaccagcatttgatagagtaagaatcccagtgctgtggaggaggtcctactcttcttgatcttttaatgccccacctgtcagtctcctgc

SEQ ID NO: 264068 - DNA, 197 bp, Homo sapiens
gcggccgcctactactactaaattcgaggccgcgtcgacagaaatgtaaatggtgttttgtttccataatgaaacaatttcacacattttcaaatacaaagtgatttcagcatggaaacaaaacaccatttacatttctgttaacagtctaggaaacttccccataagagaaagaaacctcaagggccatgctaact

SEQ ID NO: 264069 - DNA, 729 bp, Homo sapiens
ggaaagaggggccagctgacttgctggcgctgggagaaattaacccccatcatcaaaaagactttctattgcatattgtaaaatttaaaaactctcggggaatactgtgaccctgtctttaaaacatgcatctaaacaacccaaatgtcaattgatatgaatgaataaacaaaatatggtatatacatacaatgaaatattatttaaccttaaaaaggaatgaaacgtagatagatgctataacatgatggagtttgcagacattacgctgagtgaaacaggccatatgcaaaaggacaaatactccacgtatgtgagatactgacaatggtcaaattcatggagacagaacgtagaatggtggttagcagggtggaggagagaggaatggggagttattgtttaataataatatgaggtatgaggtttcagctgggggtgatgaaagggtcccggagtagatagaggcaatgattgctccaagtgcctcataggagtggaatcgtacactatttgtctttttgtgattggcttatttcacttagcatgatgtcctcaaaggtttatctgtattgtagcatgctttaggatttgcttcctttttaaggctgtctaatattcttgtatgtatacttcacattttattttttctattcatccatctgtgggcacctgggttgcttccacattttggttactgtaaataaagttgcgatgagcttcacgtcc

SEQ ID NO: 264070 - DNA, 292 bp, Homo sapiens
caccttttgatcagtcactgcctgctgaccatgccttgccacgcgtggcatggaccacaatgatgtactgctgttcccagttcacagacaaggggactgtgatgggtgagggctggtgatgtggagcctagataagcactgggcccctctaactccaagtctaagcttctacccattacccagaggcttctaacgttattctgaatctgtcaggacacctagcactgcacacagtgctcattaaatacttaaaagaggccaggtacggtggctcatgcctgtaatcccagta

SEQ ID NO: 264071 - DNA, 500 bp, Homo sapiens
cacttggaaaaacacactgtttgcatatcctgcctgacagaaaaactctggcatagcacaacgtgcccacgctgctctgaggaggtgttctgatcccagtgatacaaggcattaagatgggaaggctgcctgaaaacaagattgtttggggatttctttatactgtgattgttcaccctggtgattgtgaatggaattcaaatcattttaagcaagcagaagagttgctgaatcaccaccttgactgcaggcttccaaacttgtggcaacaaccaggaagggggagaggttaaaaattcagttgaaatgtgtacttagaaaaaattaaaaactgaattaaaaattatctaatcataatgaattataaatataaaaactattacttgatgttcttgtaccttgtaacagatcacaggcaaatttataaagatcttttaacagtactaatattttttaagagaggttcccccttttagattttgcttatgtgatgttatcat

SEQ ID NO: 264072 - DNA, 411 bp, Homo sapiens
gtggccacacggtgctgcggtgaagtctaaggggctgttcaacgtagcacctacatttggggaattacagatgccacagcctgcagggaggcacccacaactgtctcccccaaggtaaagacgactgtccttcacttacgacacaccgggttcctgcacagcgatggcctggagcatccagagaagggtccctgctctcagagccggccaggcgggctgtgtacacggccacggaaagcacccttgggggagggtgttgctgtgatttctgcacccccacttcctcacgtcctgcaacctagctagaatctgcaatcaaaagctacccagctttggaaggctgagtgggatcacttaaggccaggagtttgagtccagcctgggcaacacagcaagttcccgtctctgaaa

SEQ ID NO: 264073 - DNA, 390 bp, Homo sapiens
agacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgaggtgggaggatcacttgagaccaggaatttgtggccagcctggccaacacaacaagaccccatctatacaaaaaataaaagaaactagccagatgtggtggtgcaggcatgtagtctcagctact

SEQ ID NO: 264074 - DNA, 1163 bp, Homo sapiens
gagcttctaatgtgaggttagagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccaggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtcgtttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaaaaggcctttcttaaaacctggccagggccagaccctcggtcttggcctttttca

SEQ ID NO: 264075 - DNA, 92 bp, Homo sapiens
gaagcaatcctgtcagttccttgattttagcactaatgtcagacttctgacctccagaattgtaagataataaatttgtgttcctcaccaca

SEQ ID NO: 264076 - DNA, 193 bp, Homo sapiens
tttttttgaaactgacatgtaggctgaaaatgcttaaggactttcttctttttcagaaataatctattctgaaaatatatcttctttctgaagtatatgattatctccattgactttttaactgttaatacacagaaccaaacaaaaatgttgtctttagacagcaaatatgttattaaagctattgtattac

SEQ ID NO: 264077 - DNA, 390 bp, Homo sapiens
agcacacaacatgctaaactctagtcgtaggcaaagcttacattgttttgtaacagtacatgagattttatttggcgtccttcttttttttcccccctaagacaaggtctcactttgttgcccaggctgtagtgagctgtgattgagccactacactccaccctgggtgacaagcaagatcctatcttaaaaaaaataaaacacaatttcatttataatagcataaaacttgtgtagaaatcaagttaatgggccaggcgcagtagctcatgccaataatcccagaactctgtcaggctgagatgggcagatcacttgaggtcaggagtttgagaccagcctggccaacatggtgaaaccctgtctctactaaaaaatacaaaaaataaa

SEQ ID NO: 264078 - DNA, 430 bp, Homo sapiens
cttactttctaggggggaacatgaaactgtccagaaagcatatgctactttccagaatcacatacacagctctctaaagggaagtcagggcaactttctagaaaatctgagttaggtctctttgaagtggttcacgtgttctttccctgatgaatatctgggaatgtcccccatgtggacctggtgttcttgtgggttgagggaaagttcttggcttagagcagtggaatatggagaaggttccacacctcaggaacaaccccatgaagccattttcttttatagctttaaaaataatgaatttgtatccgttaattatatttctgtgcaattttgttgattttgatgaaaatacaaattcaactggaagagttttagataatataaaacacaactataaacatcaatgaacagttttttagaaatcctt

SEQ ID NO: 264079 - DNA, 186 bp, Homo sapiens
caagtgtgttctttctttgtagtgtgttgtttatattggtcattaaacagttcctaaaactgactttcaacttatatataagttgtttctctaaggtgtcaacattgaaaagaacagtatagagcaggggtgtccaatcttttggcttccctgggacacactggaagaagaagaattgtcttgggc

SEQ ID NO: 264080 - DNA, 523 bp, Homo sapiens
atgggcaggtggcagcatgtgacttcatcatggcgctgaggaactgagaggaggcaaaggccaggacagggcccgcttttctagtgcactgaattccagagtgtggactgaggtagcaccaccacttatcagccgtccctctctcagcctgtttgcacagggtctggcgaccttccaggaagcccaacagtttgaaacacagacctcttccatttccaaaaaagggtgtgttggtggccactccaagtcaatcgtgacccagtaggacagctctgtggcctaaggtaagctattcctaatcaatttggctcatacagaggtgcactcaatgaatgaaatgccggaacctcagaaggaagagggagaaagcctacttcctcaacactgggatctgtaaagggtcatctcacccagcaataaataaagggcaacagaagggaaaaagcagtttggctcaggagaaataaagtcccattcaagcccaaagacaccaccacaattacctagacctgtgcgcctttgg

SEQ ID NO: 264081 - DNA, 389 bp, Homo sapiens
caaccttttatatttttgtttagtttttatttgacacatattaaactccttctaccatacagggaaataagttttatttttataggaatgtttaatagccattaggtgtttagttctttttatcagaggatattatactattctcagttgtctttacagttttcatgctagcaaaggagttggttactctgctcattttgttggcaactgttttatagtcacatcatcgaagtccaaaggaaaatgttttcagcattgtgtgaaatatgattttcaaccacgtaaggtaggtaaaagtaaatatttttataactcacttgttatgacagaattcttaactatccttttatgacctctgtagcattctctttcactggatttcctatgct

SEQ ID NO: 264082 - DNA, 384 bp, Homo sapiens
aacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatg

SEQ ID NO: 264083 - DNA, 500 bp, Homo sapiens
ttttgatagggtaatggaaattgacagggtgggttattgatggaaatgatgtcataactagtctgaagactatgttatgttaactaagtatgttattacttagtctgtttaaattccccttgatgaatgagggaagattgttaaataccttgtatggtgatagtctgccctttatttttttaagtttaaccagtaaagactataataaaaggtaagatttttaaaaattgctgatagaaaagaatcacaagcaatagaaacggaaacaacagatttttattttgtattttagaacacttggcttgtaatttgcatctaatgtttgcttgcatattgtcataaaattaacagttttaaggtagtacgtttgacatgtgtgtatttttataacagcctattaaaatgatgtggaagattatacttttaaatatgcccactttgtttttttaaactcattgtagtcttagtctttcctccaataaaattgttgtgtctttata

SEQ ID NO: 264084 - DNA, 359 bp, Homo sapiens
ggacagttctccagatggccttagtaccaactctgtttactccttttctcatttgtagttctcaagaataaccatagaacatgtggaagtagttggaacagcccaggttctgttctagtctctcccgagaacaggttgtcctacagtgttttaggctagcgtgtcatattacgctcagggtgcaaaacccaggaagggttgttttccatgatccctcatctgtggcgcaaatggggcccgtacagatgactccatctgacctgagtagatttcccaaggcttggggcaccaggtctcaatgaatcctggacttttcttgtccattgctatctataagtaataaacctactttacataaa

SEQ ID NO: 264085 - DNA, 547 bp, Homo sapiens
ttccaaggtctttaggtaacaaaatggactaatgttaacctgagctaatcaataatcattggatacctagataatttctaagtaagttagaatactgtgactttgattataaagtataatattaagtttatatatgtttgcttcttatttttctatgctatagtgaggctatacctttgagttgtgtcaatacaggagttcattttttgccactttaagggaatgtaaaagtgccttatgtcactatggaaatttcagtaatgtgtgttcatgagttttgctagtctgctaaaatgattatatgggacgatttccaattgtccatatcctccctcctcctaattttctctatgaaatataaattagtttctctggttaattattataatttaaatgggtggttgagattatgccaggagcattaatgaaaaagaaatacagtggtttttgtttttcaaatcaaaacagggtagctttgtatcaaagcagtggttcttgaactttttggtctcacaatccctttatactcttacaacttatttgacga

SEQ ID NO: 264086 - DNA, 442 bp, Homo sapiens
agtttatccagcaaagtccagcaacctgggaatacaacctgcaaaacagaaggtagagtgattcactgttgaagattggcaagttgacactatgcaaggttaaatatgcaagggtttttaaaggtggtaatgagtacatcactggaaagtggggccatgttggcagaggggcaggtgaagctagaaggtgactcatagactaagagtttgaaaatgtctggctgcctccctgccattatcaaagctcaaagtatcagattttcattttctcagactcttgattccagaacataggtgcattggagatttctaaagctggttctgcaagatttagagaaattctcagagcttgctactatcctttcaacagattccgcttcatcttaagttaatgagaagagttcccccctttttcttactaatacaatgtttgatcaatttt

SEQ ID NO: 264087 - DNA, 1768 bp, Homo sapiens
  misc_feature (130)..(130): n is a, c, g, or t
gtttaagttgtcttatagtttattagcacaaaccaaaggcagcccatgttatttctggcaaagatgcactttatcgttatctgctcatggctttgtcgcaacgctcaggaatcagacactgcacacttcnatagttgggattccaaaagctaattctaaaatttaatgaaggcctgatttaaactgattcatctgcattttatctttatgaggccataagaatctaaattgatgaggaatatctttcattccgtgtatttagatatagttttctgaatttcctgaagcgatgtgatctgcttttaataaaaattcacttttaggtgtacaacaaatggaaatgaaatgttctttttaaatctggattctcaagttcttctaaaggagctactcctctgaggaaacctcaactcagtggacttgattcatctgttactttccagcattcttacaaagctggtttcatctacaatgttgtgccctaagaacaggactggggtgaaaagcgggtactcagttgttcatatatttgaggtcctaattcttggtattttttccctttgataatcccttaaagtggcttaatgtagtcttgcatatgagttaatctatcaactttcccacatagaactgatataattccttctatcaataatattgatgggcataacatttcaaaaaatgggacaaaggttcagctatctagaaagatttgctatttataggaagataatggacatgccctgctgtgatgtgagggttatttatttctgaccctgtacacagcctaggggaagaatttagtccagcaaagaggggaccttgcttagagagacccattctgactctcctccagctttctcccagatatcaggaacctagagtttcctactcagataaccgccccccacacgcacacttttaggccaaatgtaggccccctctgggggtttaaactcctggaggcaagcaacatcctgagtgcatatacctgggcacagggagtggcaaagggtgcatctgtgtggatggattaggccctggggcctggagtgttcactgtggaatttacacacaagcaaggagaagccacttgccatgaaaacaagagtccagggctgaaaaataaagggatgaggggtaggaaggagatagacaagggctaccacgaggctgggggccagtacagaacactgaacagtctaagaattctaaatctatacctgggcttccaagggttatgaaagcatcatgtgtcaaagtggcaggatggaagataatttaacagtttgttagctttatgtatgacttttaaatacttagacatgtggcatggggtcctccattggtacttttgcacaagatcctgcagacatttggggtcgatctgcctgaggtgcccttgagtcagatccctaagttggcacaaactgctaaccacataacacaaagaaaggtccaggttggaagaaggcgtctgctccacagttcagctggccctgtagttaatgctcccctcaccttctcttggacctgtggtctgactggagtataagaaattttggatgcactgggggaacaactgtgaggaaatcttgacatcgaatattttgttccatctccttcaccctctaccatcaataatccagtatgattgggatgtaaagacccagcattctgaaatgggatgctctgtactatatgggaaatgggttgttgtactttaccggttgttaaacactaaataaaatacctgtttaacagaaaa

SEQ ID NO: 264088 - DNA, 405 bp, Homo sapiens
ttaatttttttcaaaacacaattttttttaaaaaaagagctctaatccataagaagggtgccaccgtatgtagaaaagtgactgtgggactcctgaatttgccaagggttagctaactaaacacaacaagctactggctaggtggtcttctttgcccacaatacaacattggaacatgatcggagaacattttttggccctaatacacctctgactttaggaatgagattgcatcttatgtaaatacaaaaaaacccaataaattaacttttctccatttttaactttaactgatcaagtatattctcaaaatcaagtatattctcaaaagtcaaacttcctcatctttctgttaacaaaactaacaaatattttaataaatgggatgtattatggtcaattcag

SEQ ID NO: 264089 - DNA, 230 bp, Homo sapiens
acaggctatcaggttgttctgatctgggatctgtcctgttcccatgctcagatatagctcctcacacccaccctctccctctctagggcagctgcttggccttcccactcacaaccaaccagcacttactatccagattacaacaggccccttaccaagctggatccaccacccacctctcaaccatgcacaatttgtgaaatctgagaaaacctactgggctgctacta

SEQ ID NO: 264090 - DNA, 499 bp, Homo sapiens
catcacaaacccctcagacccaaaataaaattaaaaaaacaatatgtatcattaggcattgatagaaaaagactagaccctagcataaacagcctaataagaaaggaggttcaaagacgctctccagaaccagtatttcagactttctaggatgaactaaatgtgccagtacctaagattccaggaaagactaaaaatttgttttttgcaattagctgggcatgtaacccagtctctaaatatcacttcatgttatgtttgtagaaaaactgtaataagagatcaatggccataagaagcccgagaattagtgcctacagacccagttcctgatggattctcagcccaaaagaatcaccctgatcatttctaagttctaaaagtctcaattattgcatagctaaacaacaacaacaacaacaacaaaaacaggaaaagaattcactcattctgtaagatgacttagttgtctaaagcaaaaactgtataacgataccgc

SEQ ID NO: 264091 - DNA, 433 bp, Homo sapiens
caagctgggcctgagaaacaagggacccgaacctggagaggccggtgttcctggactgctctgcagtcacagattgtcacggagcccctggttgtctgaggaccccaggcctgaaccttccttgaggaagactgatttctttcagactactttgctcagtttgattttaaacagaaggctaataattatccagaagagacaggatgaggcttggacaaaggaggtggagggtatcaaaagatatttagaagataaaggaagtctggacttggtgctgtgggtataccctccctcatggcacacaccaggttattttgaagcaaatcctagacgtcatcaaacagttcaaattgcccaagtgtctcctacacacttcttttttcttttacagtttgtttgaatctgggtccaaataaagtccacacattgcaac

SEQ ID NO: 264092 - DNA, 416 bp, Homo sapiens
tctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacagg

SEQ ID NO: 264093 - DNA, 397 bp, Homo sapiens
ggagagtgagcgggtaagcaagagaaggaaccgaagcgtcacagaaatccgaggccataagttactagtcagatggtaaatgtatcagggaagtgaaagtcatctatgggttattgtggaatcatggaaagagaccatttgctttaaaggataagtatatggggtatcatttatgccagtcttaaaaaacaattttgacattggatcattccttaatgagatgaacagtggccgggtaaataaggttgctgagatttagaatagaaataccggccaggcgcggtggctgacgcttgtaatcccagcactttgggaggccaaggcgggcagatcgcgaagtcaggagattgagaccatcctggctaacatggtgaaaccccatctctactaaaaatac

SEQ ID NO: 264094 - DNA, 479 bp, Homo sapiens
cttcagtgtcactctctcacagactctcctgccccttgtgatctggacagaccctggcaggcctcgagttccctggaggttgcgccttagcgacagatgacccgtctctgaccaccaagcacctagaaggcactttcgcaggagcaaggcaggggtctggggcgcggagggggtgggcgcaagccgccctcgtccagcggttcccgccgagcatggtgataatgagggtggggccagcgttggcggtagagcgcctggtggccccggggcccctcctcgtcctccgcgcctccctgcggcgcgcagcacagagagcccagccgcttccgcagctgtcgccggagccggcagtcgcccgcctggaagaagaggtagacgaagggattgagagcgctgttggccatcgccaccacgcgcagcgccgccgacaggccctctccctcccagtctcccgcgggcccggacgaccacgcggccgc

SEQ ID NO: 264095 - DNA, 602 bp, Homo sapiens
tatttaaaatgttattgtaataacatacaatattgtaaagatagccttaaattgcaggtctaaagaaaatgtcccacagtggaacctcatatcattccattcatactattccaacaaaggtacttgatttctgattttaactgctgaaagtctttttttctttcccttttctttctttaaattttgtttttaataagcgtgttggagggcaagtagagaaaggggagggatgcatgcagaccagagtaatgagatttttatgttgaccgcaatgcgtgaccttttctgcaaccagtgagtgctgggagggatggacaaagtgaggttgggcatcctgccattaacgtcagcacatcactgcttctcaggacgtgtcaagtgaagtgggggaataaatcataggggccgccgcgcacccggggagggcgggcgcacctccccatcgtcagggatgagcccaaagctcgcgcgcccctcgcgtggaggcgccgcgacccgccttaggggctcggaggtcacgcaacgcccggagctagcgcacggcgatatagggtccgtggcgcggggctcctccccgcccccgccctgcaagatggcggccg

SEQ ID NO: 264096 - DNA, 436 bp, Homo sapiens
cagcagttgtttagggttaccgtaacacatcattcacatctcattaagttgttacgaccccgcattttctgctgcgtagagtgacctccgagtcccagctgtggcttgttctggccttgaccttttatctgatgatgttgctcccaggctgtcactccagaggccgctgatgtgggtgggctgagttaagccctcattcgctgcagtccggcccagctgttctcggcctcccgccgccgccgccgcgcacccggggagggcgggcgcacctccccatcgtcagggatgagcccaaagctcgcgcgcccctcgcgtggaggcgccgcgacccgccttaggggctcggaggtcacgcaacgcccggagctagcgcacggcgatatagggtccgtggcgcggggctcctccccgcccccgccctgcaagatggcggccg

SEQ ID NO: 264097 - DNA, 183 bp, Homo sapiens
ttatctaaaaagttgaaaagaaattaagctttactaatattttataaatgaattgacattggtacccagacctgaaccataaatcaaatgctccccatgtcacaaacaaatgcaaagtatcttgagatactttgaaagaagtattaaaattgagagaagagttaaaattccatgttacagaag

SEQ ID NO: 264098 - DNA, 272 bp, Homo sapiens
acggggtttcactgtgttagccaggatggtctcgatctcctgacctcgtgatctgcccgccttggcctcccaaagtgctgggattacaggcgtgagccaccgcgcctggcctaaatgtattgtttaaggaacagtattttattctaagaatgtataccattccttcctaccttttttcatattagaatgtgctttcttttatgaaacagcggtggtactacatgatagttgtgttttttctaatgtccttatttagccgaactaaaagctag

SEQ ID NO: 264099 - DNA, 132 bp, Homo sapiens
gctggatggggcatgtaaaccccatgtctctaactcaggtcccacctgaggacattgggatgggtggacaaagaagcaaatcagcaaatgcagcgagatgaggggcttgggagagcagctcgtcgtggggaa

SEQ ID NO: 264100 - DNA, 463 bp, Homo sapiens
cggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggagattcacttgaacctgggaggcagaggctgcagtgagctgagatcacaccactgcactccagcctgggtgacagagcgagattccgtctcca

SEQ ID NO: 264101 - DNA, 221 bp, Homo sapiens
caatcaactcttgctttactctgtccattgaaagagcagcagcagcaaggatcccatagaatctgagatgactctaaagttgattctggttgactcaggaaagtacatttcatacagagatatttggctctacactgaatttactatataaaatggaaagaaagcacgagaaaagacagaacaatggaaacaatggaagggaagcaatattgtggagtacc

SEQ ID NO: 264102 - DNA, 589 bp, Homo sapiens
tgacatctccaggctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcagttgctacacaaatgtgcagccagccttttttcttaggcccactgagatccctgctcagtgcgtctcaattgtatctccagtctaagaggagggtggggggcacccggggcctcctccactccttaggtggcccccgagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgt

SEQ ID NO: 264103 - DNA, 309 bp, Homo sapiens
aataaaatccaacctgaaacagttgacaaaagtaaaatgatgactctgtcatgtaatgatataggaagactaatgcacagacatctgtggagctccaggatttcaggaatgggtcaagccatagacgccaccaagctctcattttaaggccatggaatctaaagtccggggaggttgtgacatttccccaaaacacataaagctaagttcattcatgtatttaatatttgttgaaggtctgttatgaccaggtacccttttgcatatttggcatgcaacagtgaataaaacagacaaaaatccaggttc

SEQ ID NO: 264104 - DNA, 850 bp, Homo sapiens
ggtttggttctgagtcctgacgttgatactgctttattccagggtacctatttgaaaacaagggagttttcagttatatttgagacatagtgatattattgttttttgcttgaagccaagatgtaggtagcgattgcttccactttatttttactgtacttttatatagtaatttggacaggtgtcttcataaaggagatctttgacaagggaaaatagacccagacacccattaagacgtgttttctcccattttctccttccttgcaatataggtgggtttgatagaatagtattaggaaataccaaagaatctaccaaatgggtaaatgctacttaagtgtctgtacaggtcatttagatgagaggatttgagactatgcttgttataatttgagaattatacatgggtcaggaatgacatgagggctgaggttgaagcaatttgaaacggagagataatcatgaaactctacttggatattaataatttttcccttgaatcacacacagtggcctgcgaggcctcattttggctcatcagtttttatatgggctgaaggcatttgtttggaagatgtaaatacccttgtgtttttaatagggaaaggttggatcaagtttgctcttaattctgatcaactgacagtctttgactcaacatgaagcacactgagataaagcggatcctggtttgctgatacagatctctcagaagaggagcttgagaagcgggccttgctgggatttcctctaatcgctgcattggattgattgataggattcaggttttgttatgaacttgggagagaagtgggaagacatccaataacacccaacatttcattta

SEQ ID NO: 264105 - DNA, 369 bp, Homo sapiens
acacagcttgtctctgatgattaaagactgccacctggtttatatccatctggaaatgaaaccagggagcctaattttatgaaggcatctgcaaccatcatctctagcctaaaaagaatagcgccatcgagctttttaagaatgttgtaggctgggtgcagtggctcatgcctgtaatcccaggactttgggaggccgaggcaggtggatcacttgaggttaggagttggagaccagcctggacaacatggtgaaaccctgtctctaataaaaatacaaaaattagctgggtgcggtggcatgtggctgtaatcccagcctcttgggaggctgtcgcttgaacccaggaggcagaggttgcagttagtt

SEQ ID NO: 264106 - DNA, 425 bp, Homo sapiens
ctgaatgaagtagtttaatcagaataagtctagaagttaacttggtagaacttcgcaaccactaacaaaatagtgacaaaccaatgatcaccaatggccactaaaatcatcagctggaaaggtagtgagaagttttacaatgaatggatcaggctgacaggacatgaacccacttatctatcttatgttaatatcacagaaagggagacagccagaaatcacagtcacctgatacgatgcaatgagaagtatgtaacgtcacccatgacatgttcttgccctaaaattatttaagcatctagatattaatatcagtttatggggaatacaggagacagaggaacatgtcagttgatactgtactgatacattcattagaaccaggctaaaattctacagagcaaatgaaattatttcaaatagga

SEQ ID NO: 264107 - DNA, 336 bp, Homo sapiens
aagataatggggccggcttggtggcgcgaacctgtagcctcacctactgtcaagactgagacaggaggatctcttgagcccaggaggtcgaggctgcagtgagtcatgatcgcaccactgcactccagcttgggagacagaatataccctgtctaaaaaataataataaaaaaaaaggtaatggatgaggccgatagtcaggaatgaaatgactttaaacaattgggtatgcatgggattgggtatgtgtgtatgtgggggcagagggtgggcataaccgaagtcccatactcatgtccctctaggcctaatacattttgcagacctcacagagct

SEQ ID NO: 264108 - DNA, 169 bp, Homo sapiens
ttgtggactggtactctcctccttcagagcatgaccctaccaattcctaactgcttgtcactagattccaaaacttctggggacaaaaactttgtcttttcatctctatgtttcctgcccctgacactgtacctgacacagtaggtaaagagccaatagctgggtagac

SEQ ID NO: 264109 - DNA, 683 bp, Homo sapiens
gagagagagagagagagagagagagagagagagagagagatagagagagcgagagagagagagactgacacagagtagaacatagtaacatgcagaccattgctatgaaagttcagagggtgaagcgcgtgcttctggttgggaagagcagaatatccttcaaaaggaaggtgttgatgaaccagtcttgaaggacaacagaagtaaaacgaacggaggtgcatgtgaagtgaccattcagatgccagcaccagcataaatgaaggcccagggaaggggatgcagggaagcaccacaggacacagaaagagcagcaagccaccagtcaccatgcaaggcccagctcagccacttagggcggtatgaccctggatggacctagactttggtatctataatagaagatagttagatctggcccgccaccacgcaaggggacatgaggactcaatgagagggtaaatatatgcaaatgaaacagcatattcatgtgtgtaggataatatcaaacacagcagagatggataggagatggtctcttatggacagcagaaacactgctccacaacttccacctcctaaaatgagaaggtccttctttctgtcctctctgcccttccatgccccggcctttccctctcttgctccattttctcatcaccctcgatggttgtttattttct

SEQ ID NO: 264110 - DNA, 477 bp, Homo sapiens
tgcccaagatcacaaaatggaattaggatatgaactcagcagttggctccagagctcatactctcaaccaggaaaataaatctaatagcattgcaaagaattaattggaaaatggagactggagacagaaaccagttatgtgactgctggcataattcaaggaaaagaaaataatgtaaaatagaaacagttattctggtcacggtggctcacacttgtaatcccagcactttgggaggccgaggcaggcagatcacctgaggtcaggagttcaagaccagcctggccaaggtggcaaaaaccctgtctctactaaaaatacaaaaattagccaggtgtggtggcgcatgcctgtagtcccaggtacttgggaggctgatgtgggagaattgcttgaactggggaggtggaggttgcagtgagctgagatcgcaccactgcactccagcctgggcagcagagcgaggctccatctca

SEQ ID NO: 264111 - DNA, 573 bp, Homo sapiens
tggcttccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttaacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggga

SEQ ID NO: 264112 - DNA, 286 bp, Homo sapiens
tttcacaccatttgagtctcctttgaaattgaaggaacttattttaaaactgtgtaactcttacaataaagagtagccagattcctttttatatccattaccctagagtgtcaattccattgtgttataataactggtttgattttaatatataaaagggagctccatcattgaaatatagtataaggatcctagtttttaaaaagaaaactgtagcttggtagggatggagtattcatcagaaggaacttgatgagtatttgctctaagtatacatcttaatagg

SEQ ID NO: 264113 - DNA, 616 bp, Homo sapiens
ctctgggagaagggttgtggggcccagagtccctcacctagttcatctgaaggctccagtgatgaagcactctcacaacagcacagctgagaaaaacgggggaaaaaaaaaacaccaaagagaagatcatcatttgagttaaagacaaggagggacagagaagtcatcatacactctgcctgccagagaccagatgaaaaatgataaggatgcacgaagctgcaataaacacaccaaggtggaattagagtccagataggggctgaagccctaaccaagttgtcctgtgtccaggacagcagctgcagaccacagcttcctgcgaacacagcaggacctagagaagggagtgaaaggaaggagagtcaggattctgagcccagtactttggcagtggcagggtaagaggagaagagcaaggatagggacacatttcagttgatttgaaagcatagccacacaaattctccaaccccagggaccataggccagaccaggcttcagcctgctcagatcctcagattttaaaacaaagtgtggtatttaaaatgcaatgggatggaacttgtgattttgtaatttctgtaaataaaatatctggggcagaatttcctta

SEQ ID NO: 264114 - DNA, 695 bp, Homo sapiens
ccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgc

SEQ ID NO: 264115 - DNA, 414 bp, Homo sapiens
tctcaggaactagaaagtggcttgtgggaaattttagaatttcagagatgtggatacatgtctttctggctctagatattttcattttagagatctagaaactgctcctggctgtaaagagcgttcccaggccttccctgaagcagtcactgctgtgaccccagggcagtgtgatgcagtgagggcctcctgaacaacagctcattcttttcctgagatacagtgaggaatgactctcccagaagtcccaggacagaagtgtcatcttcaggtgtgccttctggatagggaaactgaggctcccagaatcaaacagctgctaagtgttagagccgcaatctagatcctggatttatctaaggcagacagcaggatgtgaaagggaccagaaaaacaaaaccaaacaaaagctct

SEQ ID NO: 264116 - DNA, 516 bp, Homo sapiens
cccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactaaa

SEQ ID NO: 264117 - DNA, 693 bp, Homo sapiens
ctcgattgacctgtgctgtttcaggagctgtgagacaggagccatggggaagctgacggaccagtgccaccaacaagaagaaacagcccttcctccagacaaaggctgcaagctggcctgtctgcaccgctcaggatctggagcgggaaggcctccgctgatgttctgactctgctgtggcctctagatgccttctctagcagggatgctgggtggggatccggtgtgcctggtgtaaactctggtgggcctgccctcttttcagcaccaacaccacatagacagtgatcttggcaggccaataaccaatctgggtctcctttttcttgtctgtatacaataagtagaacaatattcagctgaatttgataatgtgagtgatagggtagtatcctcatacattgtcccgttcacctattcatttcatttgttcctgcatgcatctattaactggcaggccacactatgctgggttacacactgaggattcaactaggaacaagatagatgattgctcgctgttttgaagtttacattctgggggacgcaatgataaacagatacatgagacggggaggactctgcgtgtgggtggagagccactgtgttgtgttggagaaacccgtgcttgccaatcatgccatcaagctggacactgctgcctcccatgcccagtgcatagggcctggggtt

SEQ ID NO: 264118 - DNA, 341 bp, Homo sapiens
aaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagat

SEQ ID NO: 264119 - DNA, 515 bp, Homo sapiens
aataatcttctatgattgttcaatctgttaaagaaaggcaatgaagtgaatactttagggaatgtctacattgaataggaaagaaagaacagccagggaagggacaattacagaaataggaagagaacatggagaaaatgggttttcaagggaaacactcctaactgtagatgttacatgactgaaaaaggccaaagcatctaatatgcagcatcctagtgaccttcaagggtggttcagcttctctttgagacttagaggttataaggaattaaggaaataaagaggattctgtcagtgagattcaggctaagaaacagacgagaaaaaagatggtaataaagttagttttaaggataggtagactttagcataattttaatctcagagacaaataaagaagagtttgaatttgtaagccattgaaaacattgaacaattttttgaaagatgtgggaagcatgcgatggagtaggcaggggaaaggctagtattgaacagaaaatagtgttcta

SEQ ID NO: 264120 - DNA, 238 bp, Homo sapiens
cactgatggatcagggagaacgtgactccaggatgcagcagttgcggaaggaagagaaacagtcatggggaagatcttaggaaattcaactttggctggaaccatcaactttgctacatcggccaatccaaccagctgggaattctagtaattttgctcactgcccccagacgactctatccccttatgaaggagacatatttgtaacccactgaacagaaaactggcctttaaaata

SEQ ID NO: 264121 - DNA, 678 bp, Homo sapiens
ttaaagtaaggacatgttcacagagttcctaggcctgtggtgatgctagaagatacggctttccaccattgcagggaacaaaagcgaggttgcaaaatctaatgaaagttttaaaatagaaaaactgtaagcaattttggcagataactaaagatgtagtatcttcattttcttagtaaaccaaaagaaatgatatccctaaaaattattttactaaagttatattcaattactgttataactgatatgaaatattttccttcttatagtttttaaagacctaatatactctaggcttgcaatttttgctaattttatttgtgcataataactctagcccttaaattcagcttcaagttaaaaatgaacacattaaaaatcccatcagcccaggtatataagttttacctgcacatttctacctctttggaaatagaaggcatgtaagcacagttatgacctgaaccctactgcagaatgatttgtaaagaactaggaaataaagtttagaaattaggaggtacctagcttacaatttcaatgaattattatttttttcactgaggacatcttgagccagatcaacaattaatttttaatgtaaaagaagaattacagaaagatgtgataaaccataccattacactttcccactcttcaattttaaaacacaaagta

SEQ ID NO: 264122 - DNA, 365 bp, Homo sapiens
tttgagatggagtctcgctctgtcgcccaggctggagggcagtggtgtgatcttggctcactgcaatctctgcctcccaggttcatgccattctcctgcctcagcctcctgagtagctgggactacaggcgcctgccaccatgcccagctaattttttgtatttttagtagagacggggtttcactgtgttagccaggatggtctcgatctcctgacctcgtgatccgcccgcctcagccacccaaagtgctgggattacaggcgtgagccactgcgcccggctgatttcttttcttttttaagacccagtttaaaactaccaccactttctcactcttaaataaaatgctatatgacagcatag

SEQ ID NO: 264123 - DNA, 938 bp, Homo sapiens
gaaggcagagaaaggggtagtcagaggggctggcgtaaccagaggaggctaggatcctggaaaccagaggaaaccagggtgcctctctttccttctaactccccttttgggcatcatcctcagatgcaggatatctaacatatattagcttttgatgtgccaagaagcatagatgatggcatagatgaagcatagatgagggcatgggtgaagcatagatgaaggtgttttatataaatgtttattgaggagccactatgtgcaaggcattattctagacactggtaatagagcaatgaactagacataaagtgaccctgccctcatggagcttacagtctagcaggaaacaatgacattgaggagttatatacataattaaataattaccatcatggtagatactacaaaatacaaggtacggggttttctaagaccatatgataggagtgtctgagggataaatagaagtttgttaggtaaaggaagagagaaatggtctaaacagaaggaactgtatgtgggcaggctcagaagtatgcaggaatttggcatctttcctgggacatatggttaaatgaataattctgaatgtactcaagagataattttctggaaagtaacttggcttctgtagttctgttttacatctgaattgtggcaaatgagttttaaaaacaagaccttgaaagtgaattatttgcaacgtgaaggaccgttcactagtttctgtttcataaaactgagcttagaaaaatgtggcctaaatactctgtaagttccttttagtcctaaagatctatgactttcttacatgcagaatccaagtatatatagtgtgtacaattagatcattatgcagggggaaaatcaaggaaaggataaaacatctgaaccaaaaagtgtatttagtgttagttttaaaaacatatgatagc

SEQ ID NO: 264124 - DNA, 347 bp, Homo sapiens
cccactggtgtaagtcttggagtctgaaaacctgtggaccaaaagctctgatgtccaaaagcaaaagaagatggatcccccagctccaaaagagagagtgaatttgcctttcttctacctgtttgttttattgggccctccacagatgggataaggcctatccacattaataagggtgatctccttcactctatccactgattcaaatgtaacctcacagacacacccagaaataatgttctactagttatctggatattccttaaagtggtcaagttgacacattaaactacaccctcattttctgggtccacactggaaggtgggggttggagtgacttttctag

SEQ ID NO: 264125 - DNA, 458 bp, Homo sapiens
tttagaatttttttgtctccaaggctcagtctttgggttaatatcgcagatgcacaattcataaatttgttcctcttggttcattgtttcaaaatgaaacttttaataggttctaaagccttaataagagtgctgcctggttacataatgaagttactatggttgacagatagtaatttattattatcattgtccttgataagagttatgccttgcaaagtgggtgcgtaataaatattagctataacaacataagcaacagaagaaagtttgtccctttgtgtcttatcataatgcatattcttctattatcaccgtgcctgttttctgttaattttatcaatgatatgtagaggggaactatagctgtgtgacgttattattgttagtttaaatgtcctaatttatcctgccactgtgtttcgtttagcataacaaagtcacaatatttttctgtc

SEQ ID NO: 264126 - DNA, 275 bp, Homo sapiens
cacatgcctatagtcccagctacttgagaggctggggtggatcacttaagcccaggaggttgaagctgcagtaaactgtgatcacaccactgtactcctgcctgggtgacagagcaagaccctgtttcaaaaacaaacaaaaaaccgaaaaagcattattgtgcacttaattttgtgccaggcactatttaatgcatgtcctgagaatattaagatgaaaagacagcatctccttactcttgaaaaaatcagcctaatgagaaaggtgctcttgt

SEQ ID NO: 264127 - DNA, 420 bp, Homo sapiens
acagaaatattctagaggaagaaacattttatgcaagattttaaaggaaataataactgggttagtgattaattagataaagcagatgaaaactaatgaatgagtcatagattatgccaaagttttaggcctctattgtcaggagaatgtaatgcagtgacaaagagaaagcttgctggtggttgggcaaataagtttgggacacaacaaatttgagacaaaaatggataatccaagtgtaaacataatcagcagttggtgataaagaattggatgttgggtgaacgtttgtaaatggaaatgtggatgtagatttagtcaatcagtaaacatatatggaatcactacttaaagagctctgtgtggagtagggaaaggaaatgtatactaaaatgcaaaccaaggcatatgtctatataa

SEQ ID NO: 264128 - DNA, 289 bp, Homo sapiens
gttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagccatgtggccttggggtggatggagatggggactccacatgaagcccaggaccttgaggacctgcctccctcaagattgaagcccaggaacagaccacctaccagctggggaagtggggagggggctgaaccccagatctg

SEQ ID NO: 264129 - DNA, 221 bp, Homo sapiens
gagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggagg

SEQ ID NO: 264130 - DNA, 294 bp, Homo sapiens
tcctgaaaattttcacaaggatatggagccactggaactctctcatgctgctggtgggagtacaaaatggcccagcccttcaaacattcatttggcagtttctttcttctttttagagtcagggtcttgctccatcacctagtctggagtgcagtgatgcaatcacagctcatggaagccttgaacgcctgggctcaagcaatccccctgcctcagtctcctgagtagctggaactacaggcacacaataccatgtccagctaaattttttgagacagtctctcaccctgtcac

SEQ ID NO: 264131 - DNA, 243 bp, Homo sapiens
gaaaattcatttccgatatctatactgtttatgtgactaatggtgcaaactattaaaatagtctaaatgtctcttaatagaatattgaataaatgaatgctgatgtattcatactgtggaatgctgtgttgatatggaaagttctttaagacgcattttttaaaagaaaagttgcagaacagtaaggtataaaaccacttgaacattgcctttatatttgtacttatatattcaaatgcctaa

SEQ ID NO: 264132 - DNA, 413 bp, Homo sapiens
catctggagtccagagaacaggaacgggaagaaaatgtccttttctactgtgaacatttcctaccattggcatgatgaccatctctcggagaacaagcctcagataagcatggggaccgcgcttttgcaaagatactatgtgtatccccatcctgccaagagaccatcaggagagaaaccagaatgcccacagtctttctctgtgtgctgggcacgtagtgaacttttttcttggatttttctgtgttgtaaatcagaactatacattgattattctttcattcagaaaaaaaatgcaatattaaaaaaagaaatgcatgtccttctcttccctctcctgtctcaaggtgggctggatttaaaaacctccgcataatccttagctcttttcctcttcacctatgcatcacccg

SEQ ID NO: 264133 - DNA, 475 bp, Homo sapiens
tattaaaaaatgcaggagcagaggctctgagaggggactgtaacttacccaagatcatgtggtagattgcaaaactggttccaaatccctacccttccctgtacgcacaccttttgccattcatctgcaatgtccttttctgattctgggctcagcaatataacttgctctggccaacaggataacaacagcaaatgtgatgtaagcaaaagcttgagaaatacttgtgcaactaatcatgtttgccttctctcttgtacctgtgccattgccatgagaacatgcctgggctaggattagagacacttggagcagagctgagtcatcccagctgtcccagttgaggccagcctaggtcagtcgatggcaaccaagccctaagcatgttagtgagcccagccatgatcagcacaaccacctagccaaccatcccagacctgtgatcaataaagccttactattccataccacctag

SEQ ID NO: 264134 - DNA, 505 bp, Homo sapiens
aatgaatgtttgttgagtgaccaaacgactgaattgatgagtggagatggttgatctctgaatctcctctgaattatgagtttcttgagggcagggtatgagtctaattaatcctcatgtctacagtgcctcccatgtttgccacatggggtctgcaagcttgttctgtccggctgcatttcctcttatatactacagaggccaataagattccgtggaacacacatggcaaataccaacattttcagtgagttgaaccaccagatagactgaagactgcaggtctcaccataaccatgaacactctggaccacaagggggcaggaaccaacctgtcaagtcccggggcttacatagcaggagtgttctcaggaggaaaggagcaaggcaggtcattaaggataaccagccaggcacagcctcacctgcccttaaatgtcagccagtaggaagaggaaaccggcatgggtccttcttttaaaaatgcacattcaacctgaaaaaa

SEQ ID NO: 264135 - DNA, 394 bp, Homo sapiens
aatgaatgtttgttgagtgaccaaacgactgaattgatgagtggagatggttgatctctgaatctcctctgaattatgagtttcttgagggcagggtatgagtctaattaatcctcatgtctacagtgcctcccatgtttgccacatgggaagctgatggagtcagtgacatggagcatgagaatcccaagatggttcctgggacacgtgtgcaatgaatgcaggagccacctctatcaagtactttcacgaatgaaatgcaactccagaaggcaggcaggaatgatagagaggctgagatggcagtgagggtgtgatggtcctggagtgagcttgcgcgtggctgttcagatggtgggctttgctgtcattcattcaatgaataaaaccacta

SEQ ID NO: 264136 - DNA, 739 bp, Homo sapiens
tggaaaatataatttattttacgcttgaggggattttatatcaaaagagatgaattcttatatatactagtttatcatacaggtggaaaaaggaaaaacatgtaattacagctgattttctcgtttctaattttatacacacacacaccacccccccaacacaaacaggaaaacaatgggatttgctatgccttctttcatgtggagcccctggacccttactttggctcccacctctccatgtgacggtgccactaaagctccagcagccacatgttgtctcacacgtctcagcttcagccaacactgctccacacacttggaatcctgcctcaggggccaactctgccctgaaactctcactgttcatgagtcagaagaaacccctccttctgcctttccacagcatcaggctttagtacacacttctgacactgcccaggttccatgaatcctgcattaggagggttatgcgttcaacttctctactagaccgtgcttccagaggaaagattcttatgtcctacgtgtgtctgacaccccattgccaaggtacagcatcatgcacataacaatcaattagcaaggtctgatgatgccaaaagctatcacctttaattcacaacaaatgtttatagagtagtttcaatctccatgcaaaacatgcatagacaggttataaagctctgtgttaagttcaacaaaagagtattaatctatgtacctctcccctcttctc

SEQ ID NO: 264137 - DNA, 297 bp, Homo sapiens
gcctgggtgacagaacaagactctgtgtcaaaaaaaaaaaaaaaaagaaaacaaaagaaaaaaaaaggaatgttttaggggaggcctgttctgctcccatctgagccctgggtcaactttagcgtcctaggctggacatgatgtggctcccattgggagcagtagtagtaggttggtgagggcctggaaggagacgtatctctctgagttaaggagggcacctcagaggatcaggcacatgaacagagacctgaaggagaaaaagcggaggatacacatagagatctgggggaagaa

SEQ ID NO: 264138 - DNA, 497 bp, Homo sapiens
gaccttgacaagaacaatatttgcatggggtcaaaccattgaaatttggaggtcatttcttataacaattagcctatctgaccaatacaacccctttgcccaactttcctcttggtcacaagtagaaagaaagactagagtaaatttctggagtctcagtgcatggcttcagaggatctagacaaaagaaggcatcagcagccaagctcaacatcaaggaattttgcaggattctggagtgaattttaaagccttagaaattcccacagagctgaagccatgtatctccttatctcactgtctcctctggacatttttatattcttgggagaacagtgaataaccatctccaaactagttctcgtgtgaaacccaacccagcctatgtgatttatttaatatgtttggagtctagtcaataccacacttaaacctgtcttgtttttgtcttttgttaaacatggtaattaaaaagaagaaaaaaaactggtaagaaa

SEQ ID NO: 264139 - DNA, 248 bp, Homo sapiens
ctgaaactgacttggagatccctttcttcggtctgcagcctggcttgctgaagacctaaggcaatgaccagcagtcagccagtccacaaatgccaaagagccagcatacaccagacgctgccacggcactcacaaagttttgtggtaacaaagcagagaaggcatacatacagtcgagtgctactcaaatctttagtgtgcccacacattacccggggatcttgttaaaaacgcaaattctgtttcta

SEQ ID NO: 264140 - DNA, 534 bp, Homo sapiens
acctcctaccccacgtggttttgttttctctttttgggcttttcacccccttctctacctcagaagagggtttcagttttccagtgactcataccttagctagggcagaaaagtatttagaagggctttctatttgggtcctctctgattatcagtgcaaaatcagttacctcacatcttttctctttcattacatcaagccctactttttcttctgacctctcatttttctcagaaaagaatattctcctttgcatcaaagctgttgcataggtgggagacatgctgattcttcaaagactgaatgacatacataccttctatgcatctcttgcttttcgtacgacattataaattacaagtaacatcaacttttttgtctttgttttttgagatgtagtctggctctgtcacccagggcagagtgcagtggcgctaccatggctcactgcagccttgagcctggagattgaagctgcaatgagctgtgatcgtgctcattgtggtgtgggagacagcacaagcctgtcttta

SEQ ID NO: 264141 - DNA, 425 bp, Homo sapiens
ggatatgtctctatgaacaccctaagatacagcttatttttaaagttaatctgatcatctttgccttttaactagaatgtataatttattaatatttaatataattacttttattttgaaatgtattactaccactatattgtgtactttctataggttctgctttttctttttctttttttcttcccacttgtcctcttttgaattaattgagttgcctttttttttttcaattttcccctattttagttggaaatatatgttttatttcaggattattccaaagtttgttgttctcaacttaacaatattgaaaataacttaatatctttatctcctccaaaaaaagaaaagaccttagaatgctttaagccaatttgtccttctgacatatattgtgtattagccagagctctccagagaag

SEQ ID NO: 264142 - DNA, 664 bp, Homo sapiens
tatctatactgacccactagcatatgatttttgtagtttttttaatgttaagtttgtaatgtagtgcacaaacttaattatacattggctgaggttatttgttttaaaggcagtacttgctctatggcccaggctggagtgcagtgcgtgatcatggctcactgtaacctcaaattcttggcctcaagcgatcctcctgcctcaccctcctgaaaggactgggattacaggcgtgagccaccatgcccagcctccttttgctgagttttaacaaatacagtagtgtaaccgaagatgccatcaagacaaatagaacacgtccctcaccccagaaaattctcttatgcccctttccattctatgtccactgctaccatgccacctgtgctgatttctccactatgcttccgcctgttctaagagttcatactaatggatcattgggtacatgtccttgtgtaaggcgtctttcccttagcgtcatgtttctggagattcttctgtgttgtttcatgtctcaggagtttgttcttttgattgccaagcagtccagtgtaaacacaccggtgtgtttatctgctgtattcatggacacttggagctgtgtctggctattggcgatcacgaataaagttgctgttgactttctttttgaaatctttgt

SEQ ID NO: 264143 - DNA, 584 bp, Homo sapiens
atgattaacgtcaaacatctggcaaggtcggaatgattttgcgatgagcaccgctggagtgcagtgcgtgatcatggctcactgtaacctcaaattcttggcctcaagcgatcctcctgcctcaccctcctgaaaggactgggattacaggcgtgagccaccatgcccagcctccttttgctgagttttaacaaatacagtagtgtaaccgaagatgccatcaagacaaatagaacacgtccctcaccccagaaaattctcttatgcccctttccattctatgtccactgctaccatgccacctgtgctgatttctccactatgcttccgcctgttctaagagttcatactaatggatcattgggtacatgtccttgtgtaaggcgtctttcccttagcgtcatgtttctggagattcttctgtgttgtttcatgtctcaggagtttgttcttttgattgccaagcagtccagtgtaaacacaccggtgtgtttatctgctgtattcatggacacttggagctgtgtctggctattggcgatcacgaataaagttgctgttgactttctttttgaaatctttgt

SEQ ID NO: 264144 - DNA, 307 bp, Homo sapiens
aggctcctacaagggaggtgacagatgatggtggctggaagaggggctagcagatagggcggtgaggcttagagaggtcagtgacttgtctaaagttaaaggacaggtgagtggtggaggcagagactgctctgaccatactccccatgccgggcccaggctgggcacatggtggggctcaatggttagtatatcaaatgggtccattttctccaagcatattcctactcaccaaagctaattaaagtgaaatatgggaatgcaggcacttagcagggcaaagaaagtctttcgagactccgtctca

SEQ ID NO: 264145 - DNA, 603 bp, Homo sapiens
tgaattctccctgggagggagttctggagttcctgccccagttgggaggtcccgcccagcgaggaggaatggattggggatccacttaaaaagaggcagtctggccacattttggtagagcagctgtgctgcgtgggggatcccttctgccctcagttggtttgggttctcaaaagcccaacaggctggaatggctaagttacccaaacaacaaagatggtggcctgccctgtcccctaggaagtcagtctcaggtaggtaaaacactgttgctggtggctggctggagttgtttccttgattatgtgagtaatgcgagtacctggttgtttcagttgaaggtgctgtattgacttgcccttttcattcctctccatgagagccgtgcaccctagcttcttctagtcagtcatcttggccacacacccccataatcgtattttttaactaaatcattctttaaaactctaacaaaatatttaaacatttaaaaagtgtgagctttagaaatgcctaattacatcttaggtttgagacacgtagcagttatgtacattgtcaattccagattttgcatcttacaaggaaaggacttagatctta

SEQ ID NO: 264146 - DNA, 405 bp, Homo sapiens
cccaccccaatggaagtgacaaaacttcagatgcaaaaagatctccagggacaccatctcctgaccatgggaagcagtggtgtccagactaagccagaaaggaggcgctgggcagaaacccttcaagggccaagttatgtaactgccaaagaaccttttaaaactctagttgctacagggacagggaacgggtagggggaatcgggggatccactgccacagactcttggggggcacactctgcagaggctgagatgcacccatctagttggagcccaggtattatcatgcaggagacctgggttcaagtaggtgtttgacccttggagagctttctggaatatttataccacacacagggatacttggcttgggaaaactaaataaacgtgaagtctttccttc

SEQ ID NO: 264147 - DNA, 595 bp, Homo sapiens
tttctgtttagccttgcatcacctgtcaaagtccaaacttgatccatcgtttagtgccttctgtgctctggatccaacttactcccatgtgtcatctgtactttagacacatcaagaatctgtattccctttatttctgcaaatattccctctctttcatatgtccatatgcttatgctagttcttttgtttacctaaagacccctaattactttaggagttactccaccttaatcctaaccatattttaatgttcaccttaacttctccagaaatttttctgacttccgcatttgcataatgcatatcattttctgaaccccaaaggaattggcttgtatctcttatgacactgtaacattctgcctttttaatagtctctctgatgtttttctaaaagataataaggcccttgaggttgtaaactgtcattttaaaaagtcagtacagtagcttatacctagtagaagatagtgacagagagtatattggaatttggtgcccaactacgtagaaaatgtcttcaaagctagacaaagattcccaatctggaatagtaggaaataagaaaatatactgacggtttttactggta

SEQ ID NO: 264148 - DNA, 356 bp, Homo sapiens
ttttaagacctttattaacaggtgcttgcagtttgttgacttttttgaaaaaatcaagttgtaaacttttattacaaattaaaaaggaagttcttaaaaatctcaacttgaccagatatgaaacaatttaaaaacctttaaaggcgtattcagaaaaaccaggcttttttaaaaaacacgtttgttattaccaaaaagagacgtctttaggtaaaaataataaaaaccccatgctgcatagataatgcagatctatttatctggtcaacgggcaaaatgcaagcatttaaggtcttcagctccaatcttttgttcatttcttattgctggaatttcattatttcttcttgttggat

SEQ ID NO: 264149 - DNA, 621 bp, Homo sapiens
ttccctgtagaagctacggatttgctctgactggtagaacacagagatgtttcgcgttctagagattagcattgatatatatttagtgttcaataagtccccagtgtcttagtgtttccctttcccagatgcacagtcaacctggtaaggctcctgggctcgtcttcaataagggatcagtgcccctatgagctagcaaagtcctgggaattgaaagagaaataattgccttttgtgtttactaaggcagcttctgctgatcagcctagaatttctctgcctctataaatgaagtaatgctttaggaaggtgccagtttgttccatttcaaaggtgactgtggctgggcgttgtggctcatgcttgtaatccgaggacttcgggaggctgaggcgggtggatcatgaggtcaagagttcgagaccagcctggccaacacagtgaaaccccgtctctactaaaagtacaaaaattagctggccgtggtggtgggcacctgtaatcccaactgcttgggaggctgaggcaggagaatcacttgaacctgggaggcagagtttggagtgagccgagttcgcggcaccctactccagcctgggtgacagaactagatttcgtctc

SEQ ID NO: 264150 - DNA, 388 bp, Homo sapiens
ttcaattatgttgtctcagtggacacaggtgtttgccaggaagcttaaagtcaatggcaatatggctggccagactaagaaagacaagagggctggtcacctgggcagatgcggaagtatgagtccaagtctggggaatatactaggagctgctgaccactggcccttcgttgagtcagggaggctgagagaggccacgaaaggcctgaggttcaggcagccctggctggccacttaacggtcattgtcaagaactgcaggctggccctggctccaggccttatgctcctctgttgctgggcaaatcactcaaatcctccttttatttttctgcttgtatcaataatatatgcttagtattaaagaatttaagaaatatatacaatta

SEQ ID NO: 264151 - DNA, 355 bp, Homo sapiens
gcacttcgtgttgagaaagagcatggagtgtctgaaaaaccaagagcactggagatggctaaagcaaggagagggagaggaggagcagtggcatcaaatgtggctgaagaaatagctagtagctggttctaagttctaagccatggttaggattctggatctggttgtgaaggcaatgagagaccattgaagggtttaggcagggaggtgatgttatcagaatttgttttcttacaatttttttttttttttgcaatcattgtggttgctttgtggagagtagatcagactgagccgagagaggacacaaagatttcaattaagatgttatcgagtctgggcatggtgtctcatt

SEQ ID NO: 264152 - DNA, 418 bp, Homo sapiens
aacctgctccacctatagacccaggcttcactctcacctgaaaaccctcccaggcacaacataaaaaggctcctttcggtctcacaccacatcactcatggtcattttgttgacattctttaggccacaccgtcctgctttcgattttgcagatccctaccctattgattagtctgaatgttctatcctcactttgtacttcagattgagcagtgccttcccaactctcagctgactggagagtttttgggtgaagactcacctgctttgaggaaaccgacggaaccatgaactctttagaaaagagctaccttcagcgtgttcccctctcatcacagctcactctcactccctggagagaaatggacacagtgataatttacctgttctacctcactgttcttgcccctttaggagg

SEQ ID NO: 264153 - DNA, 451 bp, Homo sapiens
agtttctttattctccttcccagtgctctttgtggtggtggtggttgtgttttgtaactagaaataaatttctatcttaatacaaagctttctttaatccctcagtgccatattactctccttgtttctaccatttgattcttctagtctatctcattaactctactaaaaaagagtatttgagcctcaaatagtttatttcctaagaacaaacagttaagtaatatgcagactgaagacttctggataagactcaaatctttacctaatatattaagctgtatttataaaaaggaaattactctttaaaaacaatacacatgctataaattgtttctttggaataatggcacacattcttcctatttatcaaatagatacatttcccagaaggaagtgggtaatgatatattatagtaaaagaaagaaagaaaagaagagaaaagaaaga

SEQ ID NO: 264154 - DNA, 572 bp, Homo sapiens
tcttgtaacaatgttttacttttcccagaatatttgatcaaaaaaacctttacttgattgtcccacttaatttgtacaggtgttatgtattttaaattatacagctaactaaataactattaattttcagttattttcaacttgtggacattaatttttttactgaatctcatcatttatggtgaaggcaagtattttttataagttgatatatagatatacagagatgagatgatagagagagagataaagagacagcaggaaaaacagagaaaatgagagaggaagaggagagggagaggtcctgttctctgttctctattatatcacctgtgggtgactatatgtttgtaattttgttgaattttttaactctgacatctctttctattccaccctctcatcatttacctatttttattgctcttccattctctttatactatatttttagatgtggagctctattctttatattcctcatctatactatagcttttttcccttcgtgttatctctctttctattacttcttatagattttcttacattgatcactttacttccttcgg

SEQ ID NO: 264155 - DNA, 405 bp, Homo sapiens
caacagagtgagactctgtctcaacaaaaaaataataataatactgaccctctcttctattaattcacagagtgatcaaagtatgagttagtgaaggagatgaaatggcgatcatccgaatctttggtgtttaaatgcttcttcctagaactgaaacatcctagagctgctaagaactcttaactgcatttctacattggtagtaaatttattctcagaacattaggatatttttttcaatcactttccttaaatacattgcatatttgaggtctcaggctgtgaaatttcaaaaatgttatccctgctgagtttctctctggataaccacttagtccttcccattttcaagacggcaattgtttttcagtaagattggctgaactgaaatgacttcagtttgct

SEQ ID NO: 264156 - DNA, 438 bp, Homo sapiens
tccagtggctccacgatgactacattccccaaattgttctcttaggaaccctttctgtgttcaaggaacccttactttacttaattatggccccaaagcacaagatagggatgccggcatactgttataattgttctattttattattagttattgttgttcatctctacctgtgactaatttatgaattcaactttatcataggtatgtaggtataggaaaaaaacatggtatgtataaggttcagtactatctgcagtttcagacatcccctgggggtcttggaacatatcccccgtggataaggggaaactactgtaaaagtttgtgttttatagagtagttgtgagaactacattaatccataatgtgtggctcatgatactcattgatagatggtagtagcaacaataaaaaataatattatcaagtaactga

SEQ ID NO: 264157 - DNA, 875 bp, Homo sapiens
  misc_feature (1)..(1): n is a, c, g, or t
  misc_feature (5)..(6): n is a, c, g, or t
  misc_feature (8)..(8): n is a, c, g, or t
  misc_feature (15)..(15): n is a, c, g, or t
  misc_feature (139)..(139): n is a, c, g, or t
  misc_feature (653)..(653): n is a, c, g, or t
  misc_feature (668)..(668): n is a, c, g, or t
  misc_feature (758)..(758): n is a, c, g, or t
  misc_feature (856)..(856): n is a, c, g, or t
  misc_feature (860)..(860): n is a, c, g, or t
  misc_feature (868)..(870): n is a, c, g, or t
  misc_feature (872)..(873): n is a, c, g, or t
naggnngnggaagangaagaggaagaagaggaggaagaggaagaagaagaggaagaagaaaagaagaaggaggaggagggaaagtagggagaggaggaggaggagaaaaaagagaaaaagaaagaaaaaaagaaatagnaaaaaagaggaagaaaaataaaagcagaaaagaaatgtctccatttacctgttcacagccacaagaaaaacattcttctatactgcaactgggtgaaacttacctgattagtacagccaagattgtcttatccaggttaggcaaaactgaacaagtagaactcctcctttgcgaaatgttttgctactgaagaccttgcttgggccaggtgtgatggctcatgcctgtaatcccaccacagtgggaggccgaggcaggtggatcacttgagcccaggagttcgagaccagcctgggcaacatggcaaaaccccatctctactaaaaatacaacaagtagctgggcatggtgaccagcacttgtagtcccagctactagggagcctgaagtgggaagatcacttgagcacgggaggtgcaggttgcagtgagccaagagcagattgcgccactgcactccagcctggatgacagagtgaggccctgtctcaaaaaaaaaaaaagaaagaaagaangaaaaggaaaagaanaagacttagctatgaactcataagccagcaggagagtttgctctctccggtgagactcagtgaaagccatcagcaaaactacagtaatgnggcactatcaccaccaaaagtgaaagaattaaagctttcgctttaaaaatgtagtggtagtcttgatatgatgtaatgagattggcactttttacctntgtngtcttccnnncnnaa

SEQ ID NO: 264158 - DNA, 522 bp, Homo sapiens
cacgagggttacttaacctctcttgggcctcagtttccctatctgtaaaatacctactgcatagcgttattgtgaagactaaatatgcaagtatatgtggagtacttaggacagtccctgaaacacaatagctcgtcagtgagtgataggtagcattattaactataatgaagtaccaagcatttggcagggctctggagtaataccgatgaataaaacatgaattttgctgtgcatatattcacattctagtcgatttgaagaaaatcaagctagtcacttaaatatagctttttgtttgtttctttcctattatctcattttctctaaatccccttcctagataatcccatccagtttcctagctgacaaagtcctaacattaactatagatcagacctcttttgggctccagagtccatgtgagtaactaactcacaggtagaacaaaaacaagatgttataacctcagcggactcatctggtttaacttttaagtgtcatagttgtgagctgtttttc

SEQ ID NO: 264159 - DNA, 385 bp, Homo sapiens
atattcctttggttatatacccagtattgggattgctgggttgaatggttgttctgttttaagttctttgagaaatctccagactgctttccacagtagctgaactaatttacattctcactagccctttataagtgttcctttttccccacaacctccccagcatctgttatttcttgactctttaatagccattctgattggtatgagatggtatctcattgtggttttgatttgcatttctctaatgattagtgatactgagctttttaaatatgcttgttggctgcatgtatgtcttcttttgcttattgacttaagttcctcatagattgtagatattaggcctttgatggtggcatagtttgcaaatattttctcccat

SEQ ID NO: 264160 - DNA, 399 bp, Homo sapiens
taaacatttttattcccacagtagtgagcagttttgttcttgttttgataatgttcatttctgcctaatcttaggcttcaaatacacctttaagaaagcccaagatgtattgagtagtagaacttcttatttgtatacctgtttataactgcactgccctggatgttatggttatttctaaggactgacctggtaaagctacttgaactggtagactgcagggtagaggcagacctagattcaatgtctaactaagctgcttagggcttacattaatttccacaggtctgttatccatatcatgagtttataagtgttcctcccaaagaaaaaatttaaaagtgatggatgaaatataatagtagatgctcaataaattccattgtatttaaagattat

SEQ ID NO: 264161 - DNA, 449 bp, Homo sapiens
cacactcctgggctcaagcaatccttgtgccactacacctggctctcttgctttgtttttgagcttactccaataacccttcatgctctttgctataaatagaaacttcttcctatgtttgatgcctttgatcttttgttttgataggcaagaagccatctttcagatttctagatagccttaaggaagttttatctagatagtttgcctacaagaggagcattaatactacccatttatggaggttttacttgccaaatttgggcagtttttatcatttaaaatctagcaaaacattatgtcagtgccctcccaggcctttaaagtcttcatgtaacagcaggctaggggttttgtcagctgtaaagttacatcttctgttcctccaaacagaaacatactttttaatctaaacaagtggatacttttcttgggagcatgttaaaaaa

SEQ ID NO: 264162 - DNA, 176 bp, Homo sapiens
cataccccacagcagcactaacatttatatactttgcaaggatgagttttctttcccttgaatctcctaggctacatccaagatatcccattttccaaaccatggagacctgtgttagctgacctatctgacattgtttccactttgttgtgaagtaaaaacctcagtgcactaca

SEQ ID NO: 264163 - DNA, 415 bp, Homo sapiens
gaccacacgcttcatagtattcagagcactggacttgggaccagaagttccagctcatcactgctgtataactgtaaagaaatcatttagcctctcgagcctcattctttgtgtgagatggagataatcctactcatctcatagggcagttgtgaggactgaatgagtttaaatgcaaaatgctcttaagacactgtgatatatctgcatccacccacttatctccctgcttacctatctctgtaaaatagggataataatagttactacttcacagagttgtaagagttgagtgaaaaggtgaatgatggaggctgaggtgggcggaccatctgaggtcaggagttggagaccagcctggccaacatggtgaaaccccgtctctactaaaaatacaaaaattagctgaatgtgg

SEQ ID NO: 264164 - DNA, 805 bp, Homo sapiens
gcattttatctcacataaatttaggatgaaattttaaaacattcttttgactaagactttaattcttatatgcatctaaaataaatgttttgagttagactcagtttatatagcttcctcgttagagtacacattttttttctcatcctccgaatctcaagagtacatatttctgacaagcttttcaatggtacgatggattttatttttctatcatcaactttctatatttaactaaagcattagtatttctagatttagtgaaatagcaaatatgaattaaaatatttatttctaaacattagatctaattgtattttgatttgttttgatatatttatgtctcagaagatatgtttaatgaattcatttcatcctctcaaccctcagttttgataggtatccacatttttaccatataaaactagactggattaaggattttgcctaaacctataccaatactctgaataaatgcagggttggagatagaattcaggtcttttaacttctaacacacttttttctccattgcactacagaagccgtaaggtcataatgatgatctttgtagagtaaataaaatattttcctagaaatatatataacaaccctacttgatagtttatagcccaaatgaatatatttttccaatcatggtttgcaaaatcatgtttgcaaacttactttgaagactatttcctgattgccacggcagataattcgtggcaaatcagaaataatatttagtgagattaattattttgcacaatatatgttgttatagcaatatcaaaatcattta

SEQ ID NO: 264165 - DNA, 391 bp, Homo sapiens
gtagaattgagggtatacacattctatctgtatgtctatgtatctgtaattcagaaagtcctttatttctcattgtgagtatggaatgttttcctgtctccagatggtattaataaattagatggtaaaggctctttaaaaataaagcctcattatgggttcattttccctctcaaactctgtagaacataaccagtttgaaaagcctctagatttgggggtgtaaaaattccatgcagcttgagagccatcagtcattaagccgctagttccaccccaagtcttgctgtccagaagctcagacagtccactgggcagcaaagaggcgctttagtaagttgaattaaagccacaaacatggctgctccctaagggagataatactgtgtta

SEQ ID NO: 264166 - DNA, 349 bp, Homo sapiens
tagaattttctccatcccttttcctggatctctagccaccaactatacaacctgctcattctgccactcctgtaaatattaacaactgggggccttctatgcttttctacaggctcatataatcatgaacatattagaaattgtgcttcctacctttcttctcttctcccttccttccttcttccttccttcctcccttcctctccctaaaccaaataggcttaaaaagttgtttacacttctaggcatttcttgcttttcttattaacagaagattggggaaatatttctagcctgctggaatacatttcactcttttttttttgagatagggggtctcactctgtca

SEQ ID NO: 264167 - DNA, 427 bp, Homo sapiens
tctgtaaaggaccagacatgcagctctcagtcacaaccaccatgccatgtagcatgaaagcaaccacagccaatgtgtaacaaattagcatggtatgtgtggccaggggcagggctcacgcctataatcccagcactttgagaggccaaggcgagaagattgcttgaggtcaggagttcgagaccagcctaggcaataaagttggaccccatcgctacaaaaagtaaaaagaaaaaaactagcagggcgccgtggtgcctgcctgtggtcccaggtactggggaggctgaggcaggaggactgcttgagcccaggagcttgaagctgcagtgagctatgatctcaccactgcactgcagcctagacaacagagccgagatcatgccactgcactccagcctgggcgacagaacgagatgctatctca

SEQ ID NO: 264168 - DNA, 376 bp, Homo sapiens
gagtgatgctcctgcctcagcctcccaagtagctaggagtacaggaaagggccaccatcatatctagctagttaaaaaacatttttttgtttgtatggagatggggtctcactatgttgcccaggctggtctcgaaccactggcttcaagagatccttctgcctcagcctcccaaagtgctgggattacaggtatgacgcaccacactcagccctatttcttattgttaaattattatagagtatgggtcaggcacggtggctcatgcttataaccccagcacgttgggaggccaaggtggaaggattgcttgaagccagaggtttgagaccaacctgtgcaacacaggggaccgtatctctacaaaaaaaatgtt

SEQ ID NO: 264169 - DNA, 420 bp, Homo sapiens
ctaattctttattttttgtagagaggaggtctttctatgttgcccaggctggtcttgaactcctgtcctcaagcgaccctcccacctcagcctcccaatgtgttggaattacaggcaggagccgctacacccagccttcactcctatcactcacacctgcaacccacttcaatgcccttgcactgctggaactatgacccagaacaaagaaagcaagaagtgccttggagttgatgtgcctgccctccctggtgcagggtatgaaagcctcactccctggccttgaggtggagcgaactcttggtgcaattcacattccagaactgcccacagtatcacctgttactcccttgcttgctgctgctgcttctctcccctgcctgctctactgccttttctttctctccggagtcctgcctt

SEQ ID NO: 264170 - DNA, 475 bp, Homo sapiens
atagatgtatactatccataagccactctgttggctcttttagaacatgtattgttatcacaaagcagatattcttgctaaaggtaaatgtgaatttgtgttcttatctctatatctaaaatcagaaagttttaaaataatattttctttatgtgaaatcgcaaatcaacccagattatgagggaggaggaaggggcattttttctttaattaatatgaagagagggccaccaagagcatacagtgaattacaaaaagataagacaaatgacaagaaggcaccttttccttcagcctggatccaggatccagggtttggcaagcaggtttctgcctggatttcatctgctacttggggcttagtgcttctgtacagtatacaaactgcacaagtacacagcaaccctgcataaagactttcagctaagaaatccccctagatagagcagcctaaaaaggtaagcccagcaactac

SEQ ID NO: 264171 - DNA, 250 bp, Homo sapiens
caaaaccagaggctctgagggacaaagaggaaggagggcagagcatgaggcagagcaacccaacagccatggaggctgaagagacgatgcaacacctacaggagttccgtgaacgtcataacaagatcctcgaccaactgaatgaacagtgagggcaggaccgctttactgacatcaccctgattgtggacggacaccatctgaaggctcacaaggccgttttggctgcttgcagtaagttccacaattc

SEQ ID NO: 264172 - DNA, 517 bp, Homo sapiens
tagtagagacgaggtttcaccattttggccaggttggtcttgaactcctgaccttacatgatccatctgcctcagcctgccaagtgctgggattacaggcatgagccactgagcccgggccagaaacaactttaaaaagtcatggtttaacaaaattagaagctctcatatatgcaaatgaaaattccaaattttggcctcttgtgaaaaatacagaagacaggagatactgggtctgtgtcctggaggcagcacctgaggggacatctgtcatggcctcagatccaggcgcaccaccatccccctaccctcacacctgtgtcatggcctcagatccaggtgcatcaccatccccctaccctcatacctgtgtcatggcctgggctccaggtgcactgccatccccctacccctcacacctgctccccaggactccatcttcctgaaacatatgccactcctgcctctctcctgggttgggtaaaccaagagactcaagagacagctgccatttgga

SEQ ID NO: 264173 - DNA, 261 bp, Homo sapiens
tatgcttaagaaaattttactaagaaaatataagaacacacatctcattacaacatatcacaacagagaaaaaataattcacataattctgaagtttttagactgattcttggaaccatttttaacaagtcaatctggtataatatgttctatacaaggcattcctcttaaactagcattcccataagcaattactacaagactacccattccgtcatcttatcaacactcagatgtgaaaggctaagcaatgacttgcaa

SEQ ID NO: 264174 - DNA, 354 bp, Homo sapiens
aggcaggctgaagcaccggccatatgctgttttacacatggaagtgcttctggaaatagtcctttcgattacatctcaaacaccccaaggaagctgatttttccaggcttgcagtggcttctggtttaaaatgacatctggcaaaaagcttctcaccaagagtttggacggcactaagcaggaagaaaattcatgctaccaccaagaactggatttgattatcaacattttctagaatctgggggcaagtttctctacttccaaagctaatgataatgggttggaaaaaatagtaaatatagtaaatcaactttgcagggtcactaaaaattaataaacaagtcttattatttg

SEQ ID NO: 264175 - DNA, 276 bp, Homo sapiens
gtgttgttttcatcttacttggttataggccagtggtgatctgggagccactggtggaccacactggcttagttagtcttccttctttcctccaccaaaagacatgcagagcgttactgccttcccacccaataaagaggatggtaggtgagaaaataaagagctatactgtaagcagagcaactgggtttccaaggagggagtgtaaaacaaaggatctcagtgtgggagtgtctaaggttgaagctgtcccaaggcaataccttctacccctac

SEQ ID NO: 264176 - DNA, 135 bp, Homo sapiens
taggttaattgtgttcatctgcagatgagttttgtaatcattttgttttgttttgttttgttttgttttgttttgttttgtgttttctgtcctttccttccctgtcccttaccacttcccttctgtcgtcttctc

SEQ ID NO: 264177 - DNA, 442 bp, Homo sapiens
tcttctcttccacagaccaaacaaccttcagctcctatgcggcacctggcatgaatgcttctgaggctctgcagctgctggaggcggacattggcctaaaggagcccatgagtccatgatgccaagactgggcagggacacccaagagctgtttctactctaggaaatggggtgagtggaggacaggggtgtcagagcctcatggggcagcagggcctgtctccctcattgccttgattgtgccctatgactgtgtccccatactgccatggagatgggacaggaccctagcccaacctctgtgtctctgtggcctttctacccagtgccaaaccagatgatgtgtttaaatatgtagatgaccagcataatggagacatgtcctgagttatatacgtaaaaccctgcaacataatgagaaatacatgttcgtcattgtaac

SEQ ID NO: 264178 - DNA, 547 bp, Homo sapiens
ccctatgaccacttctaccactctggggaattgagttcaaggaaagcttaagaagacaaaaagcaagttatgcaaatatgttatctgctgtggtgtggtaaagtttaatcccccagctgtggtgcacacctggcaaagaatggaggcgctgacacttattgatcattacttgcagttgagccgagattgcagtctgggcgacagggcaagactccatctaaaaaaaaaaaaaggcatgaatgaatctgggggaatagcaaatgcaaaggtcctgaggtgggcatccacttggacagttcacaaaagaggcatctgaggggcattgggatacaccaccccaaaatatgcctcttcgcatgtggattattttgaattaaaggccattaagaaccagcagaccacaggaaaggctctaaaaaccattttcattttgtaaaaaaaattcacatttattataaaggaaatttccacgtctccctcttccatgcaaggaagaggatatcttgtaacaactcttatcagtggaagaaagtactgacttaagtct

SEQ ID NO: 264179 - DNA, 300 bp, Homo sapiens
ttttgtatttttagtagagatggggtttcaccatgttggccaggctggtctcgaactcctgacctcaggtaatccatctgcctcagcctcccaaagtgctgggattacaggcatgagacaccacaccagcaagatatcattcttctatcaaatcagcaagcttttaaaaaaaattaatattcaatagcaagaatacaatgcatgaacactcaagctcccaggtgaaataaacttatttttgtttttgtttggatttttttgagacagagtctcgctctgtcacccaggctggagtgcaga

SEQ ID NO: 264180 - DNA, 630 bp, Homo sapiens
cagcatggtgtatcttttggacatgtccattttggaagaaacttttgtgttaaaataaactaatatattatgggctagaacataaaattcaccaagaatttcaagataaaaatactaatgttttgcttgtttgggttatttcaaacaatagctttgaaatctataattgtttcaccaccaaccctttctttacctccttgcatgctcattctcctgtgtggctagatgcatttcagaaaagtgttttgaatattattccagagcaaggatcattccagaaaataagtttaaagtttgaaatgtttattttttgtaagccatgaatcttcagcttaagtatcttctgacataaaagcattttcataattataaaagttctgatattactctccacagtattatatctgatcctgcaaagtagttcagataccagagaatactcttaaacattttgacttatgcatttaattatttttaaaatttatggaacaagacattaaatgagaaagaatggaatgaaaaatgggttaaaagaatgcaaaattgcaaaaagaatgctttgaatttaaatatttccaaaaatttgattttctgagaaaatatattaaaaatcatatctaattaccttca

SEQ ID NO: 264181 - DNA, 498 bp, Homo sapiens
ttcatctccctgggcctcagtttcccccacctggaacatggaggtggtggtagttcctgtctcggggttgctacggcggctaagtgaggtgacgcctataagatgcttagaacaaggccaggcagcttccacaggctcagagtggtcagcactgtcactgccacctactgtgccactgctcctcctggaggcagggaccacagctcgctccctgagagcctgtcacccacccaggaccacccattggtccccttcagagtccccaggctgaacagaccaaaagcattgcacacacttatgcagctggtatgatttctctacccagcctctggtttttcagctttttttggaagcataaatcctttgactccaacaaaatgttaaatgctcccctaagatgtcaagcaggttaatgcatagctctctggttgaaggtgaggatggaagcacagagcacgttgcctgcccctcccccgctaccaccagtgctgtctgagc

SEQ ID NO: 264182 - DNA, 256 bp, Homo sapiens
gtcccaatgagatgaaccatgtacctcagttggaaatgcagaaatcacccgtcttctgcatcgatcacactgggagctgcagactggagctgttcctatttggccatcttggaatggaccctcccacgattaatcttttaaagttcacaaatgatttgaacatgcagtcaagactgaaaaccactgatgtaaatatagccattttcctagtatttcttctattttcctttcctttctttttttttttttttttctg

SEQ ID NO: 264183 - DNA, 421 bp, Homo sapiens
atactttaagttctagggtacatgtgcacaacatgcaggtttgttacatatgtatacatgtgccatgttggtgtgctgcacccattaactcatcatttacattaggtttatctcctaatgctatccctcccccctccccccaccccatggcaggccccggggtgtgatgttccctgccctgtgtccaagcgttctcattgttcaatttccacctatgagtgagaacatgcagtgtttggctgggaataaactattttttaagccctttggtgtgtggtcatttcttacagcagcccccacggaggcaaacaggtgtcacatatgcccccgaatttgggagatgacagaggcctgaggagggcccagagagatgaccttggggttgaggcagagttagagcttaacagacacactaactcta

SEQ ID NO: 264184 - DNA, 439 bp, Homo sapiens
ccccagactcctaaaagtcaagtccattgcttcacttttctgtacctccgtttcctcctctataaaagagagaataaccccaatattaccaggtgggtgcgctaatcagatgaagtcgccctggacggaaagtatccacagcaataaatgatttggcttgaaactgtcccattctcatccctctaaatgccttttccttggccctccattctcctgctcgctccctgtgctccaccagggaagccacagaagttcacaaccagaagaaagcccattttacagatagggaaactgaggcttggaaagggcaacaatttactgaaggtctgacagccccgttggaacccggggattccccaacccggggcattctccccgccacgccccgtcccggctgggacagagtgtccagcctcctcgccctgccccggcctccaga

SEQ ID NO: 264185 - DNA, 226 bp, Homo sapiens
ctgaaggtctaggaaattttgtattaaataatagtaatgtacaaatcattccaaagcagttacaatcatatgaactgaaaaataaaattctaaacagctttattgaggtattagttatatactataaaattcacccattgaaagtgattcagtgatttttagtaaatggaaagagttgtacagccatcgccagaatctggtcttaaaatattttcatcaccctacg

SEQ ID NO: 264186 - DNA, 475 bp, Homo sapiens
atggaaaatggaagtacaggtagatccctcaagtcacatcattccttcttatactacagatagtagggatggaagtggctttcatttcacatacacggaaaaggaagatgggatggaaaaggaaagtcacagaaattttcagtgattattgggtttagttattacttgtcattatttatttattattatttaacttgtattattatgacagttatatacagatgaagaagatataagggacattatgttaaagcattaggagtgttagttagctagtgcctagttggaatatgtaactaatgtttagaattgtcagttggtgcttactggaatactaaatttgagtaaaaattttcaagtaccaaaatacaaataacagcaaaacaaaacttaaggaaaaaaactgctttggggtccaattaggaaagtatataggttagactcagagcttaagtgttagcaagtaggttaaaat

SEQ ID NO: 264187 - DNA, 353 bp, Homo sapiens
atgcaccatgcactgggctaggcagtttatgtcaactttttccattctatcttctcagtaaccctatgaggtctggttatcttcattgtgcaaatgaaggcagattcatagaattaatagcttgcccacagtcagatcaggatttaaaatcaaaagttcttctgtcttgcattaaacaaacaaacaaacaaaaaaccttttccattactccaccctgtttctttttgctaggaaataaaaccacaaatacaaaaacaagcaatcatacaagcaagctaaactaatgtggtttaaaaagcacctttttatgttttcttccaacattttattaacttttccaacgtacacatagt

SEQ ID NO: 264188 - DNA, 432 bp, Homo sapiens
agtgaccatttacatagtgtcctaaactacatgctttcctgtgacactgattagaatctgtcccttagagaatgtcagcatcatctttgatttagcagcatcttaatgttgtatagaagtgtaacaacttataactgcaggataaaatatgtttttcagattaaggtgatcaataacctctaattccaaacacattattgctaaattacgatgcatgtgaaatctggatacaagttaactactgattaattcattgtgactcgcttggcttagggatacagtttaaacatggaaagataagagaagaaaataattttgttcatttggactaaaactgtagttttggtttcttcagaacaactcaagaatttatattattactggagaattagttttgcttcattttctcatagattagtgatacataaaggg

SEQ ID NO: 264189 - DNA, 287 bp, Homo sapiens
tgataaatggcagggtcatttcattccttatctgttgctacataacaaattaccccaaatcttagtggcttgaaacaacaacaaacttttattatctctcacagttcctatgggttaggaatttaggtgtggctgaacttggcagttcaaggcattggctggggctgcaatccattggaaggcttgcctggggcgaaaggatctgttttcaaagccccgctctgccggttgagggtgggatgcctcagttcctctccatatgggcctctccatggggctgcttgggt

SEQ ID NO: 264190 - DNA, 765 bp, Homo sapiens
tgggttttgatacataaccccgttccaccatatcttattttccggtaatataaaattttataatgttataatgtaaaaaatattaacctatatcattttatatttctcagtgataaggttatagtggtttcttcctgcatccttatgcttttatttccaagttttttgtggtcagaatatatcacttttaacaattagaaaaaaaaaaaaaaaagtttttgaaaaatttttgtgatatcctccaccacagaagataagcaaaaaaagtccttgcattcaaagggttggaaaccactggattaaagtatctactcaccttctatatttcttaaatgcactgtatcattaacaagcataaatgtgctatgtcattaaccagcatagaacattactaagtgtatattaagctctcaattgttctcttatttgttaatagctattataattttgtcttagtaggaagtctgttgagattctgtcattgagatgtatctctctgtagctatataaaaatgtgtgtctcacacacacacctatataacttatttaagtgtgtagtaaattctcacttaacattgttgataggttcttggaaactgagggaagcaacatattaagaaaactaattttaccagagtttaattgataaccagagtttaaaagataacgagttatgtttgaatggcttgaacccgggaggcggaggttgcagtgagccaagattctgggactacactccagccttggcaacaaagcaagactgtc

SEQ ID NO: 264191 - DNA, 439 bp, Homo sapiens
tggtaatttgacatactaggtggttagtaactactgactgtctccaggttacaacacagttattacccacttgggtgaaaagagaagacaggaaatacattttggagttggctggcaacctgtttacaaagcaatttacaacagttccttattcttaaggggctattctaatacaagacctcagagaaacagtgcagtgtgacaaaggaggaatttatcaaaggagacagaaaaagcatcaaggcaagctgtgaaatggtgcggtaggaaccaaatagagagccaaaggatctttctgtcactgcaggcccttaggggtaagcaaatccttccctgatccctggtctccttatctgtaaatgagaataccagcacccacctcactgtgctgtaaacatgatgagttctaacaataatttataaattgtaaaatcacaca

SEQ ID NO: 264192 - DNA, 356 bp, Homo sapiens
ttctagagtttctacacaggactaggcatcagaaaacatatgttccaaaagtgtgtcaagggtcaccatggaaaccacagggcacaacatttgtgtcccaggcttctggaacactaaggaccgaaagaacgtgagtgagagcaggggaatttaggaatccattgaggatgcctgaatggggttgttggccctgatcacactctagagacaggcatatcatcacaggcaatcagaaatgaagaaggacattaacttgtaccctgtggaattgtcttcagttgataaaaaggacttctctgtgagtgtatattttaattatgctgttagctaggagtcaattaaattacaatacctag

SEQ ID NO: 264193 - DNA, 2059 bp, Homo sapiens
  misc_feature (3)..(3): n is a, c, g, or t
  misc_feature (5)..(5): n is a, c, g, or t
  misc_feature (1709)..(1709): n is a, c, g, or t
  misc_feature (1948)..(1948): n is a, c, g, or t
ggncnagcctgtctccgcgtggtgcgagcgctgcaccagcccctggctggtggttactgtccgaacggcgtggtgtggtcgctgactctctgggcgtgcagctccgcagccctgccggctcggttcggttcgtgagcggccgggattgacttacgcaggattctcagcccttgcctgggagaacagttcaggagacagatggcccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtanttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaantatacccatgataatatacccaatatacccttgttaaagaagcaagtttcaggaaatctatattatatgcattcaaaaagacctggacaaataaagaccaatcttaacagc

SEQ ID NO: 264194 - DNA, 186 bp, Homo sapiens
gctgggcctgtacatgccctcgggaagcaggaggctgggcctggagaggccgacttgagaaagttttgctcctggagaggccactcagaggcaagagctgggtgtgaagaggctgacttgaggtcgattttggcctgtagaagccactggtagctaggagttggccctggagaggctgacctgagg

SEQ ID NO: 264195 - DNA, 300 bp, Homo sapiens
  misc_feature (242)..(242): n is a, c, g, or t
  misc_feature (251)..(251): n is a, c, g, or t
  misc_feature (276)..(276): n is a, c, g, or t
gcggccgcgccgagcccgcgagctagagaagcgccggagccagcgcgcgggccgccagcgaggaccctcccccgtctcctccccgaggccgccgcagccccctgctctccttaagggtctttcccagatgtgaaggtccctcccaggctctactgaggtcagaccaattcccagtggcttgggtaccctcgttcactccagcaccagcccctgccctccttcttcccgggccaagcaggggnctgtccatngaagaacgctccttggagttgcagnctggaggggcgagccccggcagcc

SEQ ID NO: 264196 - DNA, 289 bp, Homo sapiens
gaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctccccacagagagagcgtcgggtacggagc

SEQ ID NO: 264197 - DNA, 464 bp, Homo sapiens
  misc_feature (406)..(406): n is a, c, g, or t
  misc_feature (415)..(415): n is a, c, g, or t
  misc_feature (440)..(440): n is a, c, g, or t
gaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctcccccctgctctccttaagggtctttcccagatgtgaaggtccctcccaggctctactgaggtcagaccaattcccagtggcttgggtaccctcgttcactccagcaccagcccctgccctccttcttcccgggccaagcaggggnctgtccatngaagaacgctccttggagttgcagnctggaggggcgagccccggcagcc

SEQ ID NO: 264198 - DNA, 188 bp, Homo sapiens
gtgtttattgaactttttacctggcatattcaaatcttatttccaaatacatacgacagaaaaatttagattcttaaagtagccacattcaaattacccaggagtaattggccacctaagcagctggataaagcaatttctttgaaatacatttcaaggccaagcacagtggctcatgcctgtaatcc

SEQ ID NO: 264199 - DNA, 485 bp, Homo sapiens
tattatatataataatgagatgatttaataaattccatgtgtttctatggagggggtttgagagtcaaaagaaatttggagacgctgaggtagacaaagtgcggcgtataaggttcctgagaagagaggtgggttgggataccaagcactgagcagaaaatgatagtgaactgggcgaagggtcacctcctccgttgccatcgcagcagctgtagcagaagagattatatgagctgataaatgcaggcttatggatacggtgctggaaaggtaacctgatgccagacttagtttattctgtgtttattgggcatctgttttgtaccagtcactgtgctaggcctggagacacaaagatgtaaaagatatactctgccttggagaactgcgtgaactcggagggcggaggttgcagtgagccgagatcgcgccactgcactccagcctgggcaacagagtgcaactccgtctcaaaagaaaaaaaa

SEQ ID NO: 264200 - DNA, 187 bp, Homo sapiens
cttgacagatttaaaagactgaaaatcacacaaaatatgttctcagaccacaatggtactaagctagaattcaatagcagaaagttagctgaaagatccccaaatgtttggaaattaaacaacacactcctaaataacatatgggtcaaataagtctcaagagaaattttaaaatactttgaactaa

SEQ ID NO: 264201 - DNA, 452 bp, Homo sapiens
ctaaaaaattcctattgtctagtgacatcatagctgttgtaatgttgcagcacagtgcaatacacatgtgatgctcgtgtaaacctactgatataaaagtatagcacaattatgtacagtatataatatttgataataagcagctctgttactggtttatatatttactgtactatactttttatcttttcataccttttagatactctaacaataaagagtataatatagtaaatatataaaccagtaaggacaaccttgggcaggaccttaggacaaattccagaagaaggtgttgctgtcatagctccatgtgtattattgtccccgaaaaccttccagtgggacagaatgtggaggtggaagacagtgatatagatgatcctgaccccatgcaggcctaggctaatatgtctgtgttttagttcttaacaaaaaagttttaaaagtta

SEQ ID NO: 264202 - DNA, 399 bp, Homo sapiens
aaagatgaagaaggtgagaaagagcttgaccaattaggatagaaatttgatctagataaacggtaagcgtccgtaaagagctgtgtggaagaaagcactattcaattaaattatgtccctggataatgagtcctgttggtgaatgtttagtaggaaagattagtatttcaaaaggtaaatatggattcgccctggttacctgagactgttgaatgcgtttttctataagttgtaattcagaatctgcctcaggggtcaaagaccttttgttgcataaatcaggattgccccataatgttgcaaacagattagacatagcatatgtaagaatgcctaaggaggggcaaatccaattaatatctccaagcattttttggaaatcatttagcgtttttagag

SEQ ID NO: 264203 - DNA, 395 bp, Homo sapiens
catacaacaccaccctgtggtagatactgttatctttccctttttacagatgggaaaactgaggctcagagatatcaagtaatttgcccaagtttacaagctggaggcaatgaactggattcatactcaggtctgtctgagctggagcctatgttgttaaccagtgtgctctccaggcacttttgtaaggtttggtcataaatattccaaacttatttgactactgacacccatctacactgcacagtgtcatcgacaagatcaccaaaagtcttctctcaaaatgtactcgtctgtgctcctctaattctagagggttacagcatccatctccatccctctattgttctttcaggtctttgaggggatacaaagctccttatctacctgtaaag

SEQ ID NO: 264204 - DNA, 504 bp, Homo sapiens
atagtgacacttgtttctctccctctttgatttttctccaaactgcttggggttccagaggacagctcttctagaaatgtccctgtcttatctcacaaggcctgcaggaagtgtatagtctacaatcccagccatgacataaacaccagtctttctgaaccacatgcagcattgcccagctctggcatatcggaaatgagaaatggctatatgttctggggtatgactgcagcactgtgtgcagggtgcttaccaagcattagggccgaaaggggttgaagactccttcaaactcttgttttctgaatcaatttttacctgtttttcttctgacccgtcctgataaattttcagatagcaaaccttttggtatagtgacagtcaaagtcatttgcaaagcatagaataagtggtttagatgcttaggtatatttttcactttgaatgttcattctgagccagttttgtttatgtattaaaataataaaataaaggattaaagcc

SEQ ID NO: 264205 - DNA, 444 bp, Homo sapiens
ctcgcctttatcttcttgggaagccgagattggacataaagtagaatgatgtgatcagacatgttaagacagaaagagcacttggcatcagtgtggggtgtggttgcttcctctcctgaatgccttccttgttgtcttcatctgactagcactactcatatttaaagattcagctcaagcgtcacttcctttagggagccctccatgatcttcacggcctggccacctacccgtcccatgggcctccgttgaagctgacataaacctggatcacagagcctgacacatcttagggcacatttgtttcccggccagcctgagggtctgttgaggattgggctcctgtctgcacttccctatggttggcagctggcacagaatccagcattttataatgactcactaaaaatatttattgttaaataaataagaataagcatcctc

SEQ ID NO: 264206 - DNA, 391 bp, Homo sapiens
ctcccttgaaccccaggagctttggccaccaggatcacaaacagattggaccaggggttatgacatctgccctgtcctcctgtccagcccctgtgcaatcataagctgggttaccttctgagcctgtttcctcaactgtaaaatgagggttctgattataactataccccaggagtgtcaggataaatgaattggatctttctaagttcttaacccactgtctggctcattgtaggcatttgaaaaatgttaattattaccataattgttaatatcattattgtgcatgcattgtgctaagtgagtgggcacgttacataaacctttagcctcagtttcctcaagaaaatggagtcaattatgaacataatacagctcatatgcattcctt

SEQ ID NO: 264207 - DNA, 401 bp, Homo sapiens
aggaagacaggcagtgagccaatatatgagcatacagtgtgctgtgtggtgatcagagcatggaacaacagagagttgggtaaaggcgtggtggtcagagggtttgctattttggatgaggtgtggagagaaagcctcacctataaggacacatttgaaaagggacttgaaacaatgaaggaggtttccaggcagagaaagcagcaagtgcagaggccctgaagaattctaacattgctggagctagtggcctagaaagtgaatgaaaggagatgaaatcagagctgagtggggcaacagatcatgtggggctctgtaggcccttagaaagggtttggggtttttcttcaagtaaattaaaataagagagcaaatgaataatcaggaaaaaatgttttaag

SEQ ID NO: 264208 - DNA, 228 bp, Homo sapiens
gcctcgggcccctcctccacggcatgtgggcacattgtgcagagacgctccgaaagcaatgcatggaactgagtgggggctggcttaaaggccaaaacccaagcctattggattgggtgaggagagcgctggtcccctgaccctcaggcacacactccacagttgcaggctggacaggctggggggtttccgtccttcagaggaggctcaggggcaggaacccccttg

SEQ ID NO: 264209 - DNA, 259 bp, Homo sapiens
gcgggtgcgagcgctcgtcgggctgcaggtgcgtcctcccgcgctccgtgggcaacggacgccgatttcgatgtcgcgggcctggccgcctgccagggtcgccttccccggagcctccgctgggccttcttggacgcggtcgggccacggcgggcgggaggcgggcgcccagcatggtctgaggtcccagcatcctgaactccacactgggaccttaatttggttttaacacaaataaatattctcactaaagataaaa

SEQ ID NO: 264210 - DNA, 441 bp, Homo sapiens
aaaggggtagaaaacttagtagtttgaggagtactgtgtatgctactacctgtaacatttttctctatctagtgtattcttagttcctgtaaatgaaagcaataatttattgttggattttaccagataactctttagcaaaaaacaatacaaattattgtatccctttcttaaatatttatatatgcatataaatgtataaaaatttttgtgcatatttgaaatgtatctaaatttatgcatttcattgatcaacttcctccattcattcaatgttgtttttgaaacccatccaggatgataaatatagatgtttaattctatgtatgctctgcatagcttcctgtcatatgactacatgtattttatctgtccattcagtcactggtgtcatttgatatgttcaacacttttgctaataaaagcagtacctcaatgaca

SEQ ID NO: 264211 - DNA, 271 bp, Homo sapiens
aagcgcgagacggtttgactcttgtcattaagacaagaagaggtttggaaaaaatgcaaaaccaccgttctcttggctgcatcgggagacgggcggctgcccatcgcctcgcacacgcgggtgcgctcggagcccgtccgcgtagacacgcctgtgcgcggggcgggggtccccggcgcggcccggagcgggtccatctgcccggcgagggcttccgtcccgccagccgctgacctccaatctgtcactctctcggctgaaaggcggccgc

SEQ ID NO: 264212 - DNA, 922 bp, Homo sapiens
cgaaggctccgcggccctggagagccggctttagggcagccactggccgggcggtctcccaagtcaatggcctctgtgggaaaggcagtgatgtcacctcgaatgtattttcggggctttgccctgctttctcctgatctctccctctcaggctgtttccctgttttatttttctcctctttctttctctccttccagcttctttgagggcattatgacttttttccaagtttagagctcaaatccactgaaggcccgcacgcagccccatgactgccatggcaacgccgggcctggtacactttttttttttttttgcataaaaagtagagaaagattgaaaagagggacaagaatgaaagggggaacggagccagtttggcctgcgcggggctggtgtctgctgggcaaggacagaagcacacggggaacgggactcgtgaggccggaggagccagcggaggggcctttgagaaacaaatttgtgatccttcacggtcaaagcttccgaaaaagctctgcgcttctgacggatgacaagagagggagggcaacaaagttctcacaagaaataaggtctcgcttttgaacatgtacccaattgcatagtttagaggaagctttcaaaaatctgtctagcctctcaaaaagaaagacaaaaagaagaagaagaagaaaggagcgaaaagtctcaaaaggacttttgacctgtgtagaaagagagcagaaaacacgctgacacatttcctggaatacccaaggtccttgagctccctattgttaaacggcctcagtggaaactcgaaggtgtcagctgtgtcaaatcaactcaaaataatcgatgacaaacagaaagagacattcattactgtaccttcttcccctagagaatataacattaccttgaactcctgaaagaaaa

SEQ ID NO: 264213 - DNA, 459 bp, Homo sapiens
cacgaggaaaaaaactgctctgggcttctctggtctaagatattcaccactttcagggatctccacttagggactggctgtccctcattatcaccattccttctctggcaagtggcagccctttctctgaagcgggcagcagggatgtcattcacagtcacatcctacatcacaactgtgactggttggttggtgctatctgagtcttgcccagtggccagtaagagccatgaagacaggctcctgttccccaccacggcctctgctcagtgcctgtcccccagacttaagaaactgatcatctttacaatttggtcataaccacatcatactcacataattatttacccaatgtttttctttagaccaactttttatgatatttaaacaaatttatttatcatgataccacttttcacctcattcgacctataaaatcatggacttttgggggtcttt

SEQ ID NO: 264214 - DNA, 572 bp, Homo sapiens
ttgagacggagtttcgctctgtcgcccaggctggagcgcagtggcgcgatctcgactcactgcaagctccgcctcccgggttcatgccattctcctgcctcagcctcccgagtagctgggactacaggcgcgcgccaccatgcccagctaatttttgtatttttagtagagacggggtttcaccgtgtcagccaggatggtctcgatctcctgacctcatgatccgcccgtctcggcctcccaaagtgctgggattacaggcgtgagccaccgcgcccggccggatctttgatttatgaagactcattgtttatcatcaaagttaccagtagtcactaaaaaaaaaaaaaaaacttttgctatttgcagtgtcaggcattttgtgccacaagctgaaggcaactggttccctttttcacccacaggattaaaaaattccaggaatgagagaaaactaagttaggctattatgagacctatggcaataatcccctagatgtgaagctagtcttgttttgttttttttttttaaaaacacaaaaacaaaaaaacaagattatactttttcttta

SEQ ID NO: 264215 - DNA, 320 bp, Homo sapiens
gaagtagatgctcaataaacacattttgtctgatgggtataccttgaaacagcaaaagtaaagtctgtttcatcataatttgatccgttcacatttatgggccagatcctgtggtagacctgggatacaaagatgaactaaacagagactctgctctcaagagtttatataatctgcatttgcaggttataataaactctgatctgcatctttgggcaaaagcattcttttctaggtatcttaaccacgatctcaagtatgtgctctgtgtgtttactgacatatcatcaaacacagtctgtagggaaagtaaatgaaat

SEQ ID NO: 264216 - DNA, 925 bp, Homo sapiens
tattcctattaagtaccaggcattatttgtaaaaggtgacatcctttccttatcctgggctatttctggtggttcctcaacaggtctaccattttctgtcttcttagaggctttgcattgtcttccactagactataaaaagtgaggtaatgaaacagacttgtgaagaaacggagatgagaacctaatgagactttccagttctagtcctaggtggcctgactacactgcatttcctgtccttggatgtccataaaatcaaataacctccttggaatgtgtttctatcctttaccaccatacatagcttggctgcttatctttctccttatatgattagccgcttgagtgtaggtaccatatgatctttatttcatgagttacttttttaactgttagaaatgcattaactgaacttacatgagttactatcatatatgcccttccacacgccaggcattcctactctccactgtccaactcaggagcatggactgctaaaggcatgttccttcacaaatctactcagttccatatttggctcccagagctgactagtcctgaaacaagtgtccaaatctgccactcacacaccaaaaaagccatctcagacagaagattttactgttaaggaaaaccaacctcctgctggaatccaagatttagagggtaaaaggaaacaggagggctggaatcttgatttacagttgtgagcagaaacaaatcaatagataacatcacatgatggctaacggtagctgggaacaaaacaaaaacccaccaaaaactgacttgatgagtcctgatatgtcaagtacctaacacaatgctagatacctatgaagcagataatacatatttgttcagtaaatgaataattgaagagttaaataaatggttgaagtgtgatatacagaaaagaata

SEQ ID NO: 264217 - DNA, 358 bp, Homo sapiens
tataagtaatagtttttaaataaagcattaatgagcccctgctatgtgtcaaggtctgtaggatgctaatgacttcctggggatacagagacagcaagtcacaatccttgcccttaaaggacttatagggtttaggcaaagcagatatttaaagaggtgaataatattatagtagggttatgtattattatagcaatatttacagtatgcattgggagccctgaagaaggtagcacaaagggagtgatagttgatgaatacaagttttccaagcagagaatgggatagtaggggggtgggagcatttcaggcagaagtaacagcatgaataaagtgtgaaaaagatcatggaatgttc

SEQ ID NO: 264218 - DNA, 419 bp, Homo sapiens
tgatctattctgacagtccctgttgcaaggtttctttccatgtgaacatcattgatttagtaaaatggggagaggaacaggaagtgtttaatttatgctaagggttggctctaggattccctatctgatgtatgtatctgattttccccattaatgataaaaattgatacatgtcgttacgcatttgtccaaactggtagaatgtacaagcccaagagtgaaccctaatgtaaactatggacttcgagtgacactgtaggctctcagttgtaacaaatggcccactccaggggggtgttgatgactggggagactgcacgtgaggggcaggggctctctgggtaagctctattccttctgcttggttttactgtgaacctaaaactgctctaaaaatatgacatcttttttaaaaatct

SEQ ID NO: 264219 - DNA, 101 bp, Homo sapiens
tccgccgcggcacctggacctctactttccgaggtgagcatttgggggtcgagggcgtagagcgatcgcaccctgaatggagcccagggcagccagcgacc

SEQ ID NO: 264220 - DNA, 441 bp, Homo sapiens
aaaaatgccattctctggatgtgctcataggacagattaaatactactattccaattgctgaacagaggaactagaaacaaagaacctctaaaatgagaaaaacagataagctttgtataggagatccccagagccaaccaaagattgggtaaaaggagatactacctggctctgccaggtattcaatattgaatacctcagtttctcccaattgaagtgtgtaagaatgaactggggcctaccttgcctccattggccttgaaccttcagggccctggtttcttctgcatgtagatcatttcctaggaactgctctgcctcctgagccccagatacaatatttcttgggatgatcaacgttcttacagatcagcactgctcctgccaccaaaattctccataggcgcccttaaataaatacaattcttacacttgaaaaa

SEQ ID NO: 264221 - DNA, 1599 bp, Homo sapiens
cgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgatgggcaggggggttactacaaccttatagaaataaaatttctttaactctgcctatatttcagggtatagtcctcaggtaaagcttcacattgtcaagaagaacttgaaaataccttttttccataaaaacacaatgaaactaatactatgtaacggaatattccaaagcactagttcttataaataactattggccaaaatacaaataactgacccaattcaaaattctctaagatttcattaagatccttttgtagttcataagcctgatgcatgggtgttcacgcgcatgtgtgagatgtgcctccctcaaaccttgttatggcgccagcccattaccggtctgtcatgaaaaaaaaaatatttcagtaaaagaggatacttctagtatcctttttaaaatttgaatgggaagcaaatagtatttcatcccagcatgttaaaattgcaagggtcacctaccccagcttaccatttgctaaacacgcatcagtcaccagtggaacacacatttccaatgctaaaggtcttgactgcttggtgaaaaccactttgcaacactggtgttggaaattactttcttatattaagctgaaatctacctcattggaacctctgctcataagtcctgagtctcatgtagttcagaccttgtctcttctgccccatctggctacttatctccagtttctcctgccagtcttccggtggcatagccccaaaccctttcatttcatagtttgtcactgccctttttaagaggactggggtgctcagaacttattggctgaccctagctcttcctttggcctggtcactatatttgaaaagtgctacctgaaatcataagagcttttttgttttgtttttaacagccattttctattgttgattcattttagttttggttacaactgaaatatctgtctttcacatgaaatatagcttctcatttgcctttcttcacaaagtctgttctaactacacatttccttggcttcagcctcatgcttgatgcagaagtgaggagagtgcaataaaaatttgaacagttgcttggatttttgcaataatagattgtcagttggggtcatatgactctcaggtgctagaaaatactctgcctttcagaacgtaaccgtgggcacactgaatgcaactgtataaaaatgaatgtgaatttttaaaggtagcataattaaagtttgtacattttaacagtttatgtaaatctgtctcatagaatacatgtaattttctctgaggtggatgttgtgatacttgatcaatatttgtcacctacagtaaatgtaccattggtcttggaggt

SEQ ID NO: 264222 - DNA, 672 bp, Homo sapiens
cgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgatgggcaggggggttactacaaccttatagaaataaaatttctttaactctgcctatatttcagggtatagtcctcaggtaaagcttcacattgtcaagaagaacttgaaaataccttttttccataaaaacacaatgaaactaatactatgtaacggaatattccaaagcactagttcttataaataactattggccaaaatacaaataactgacccaattcaaaattctctaagatttcattaagatccttttgtagttcataagcctgatgcatgggtgttcacgcgcatgtgtgagatgtgcctccctcaaaccttgttatggcgccagcccattaccggtctgtcatgaaaaaaaaaaaagtcgacgcggccgcggaatttagtagtagtaggaaaacgc

SEQ ID NO: 264223 - DNA, 396 bp, Homo sapiens
cacatcggtcacagggaactgcttcccaaaaggaagcgtggcttgactgggactttcctcactgagaatgttctgttgggagaccctggccaggtaggagaaggatccctgggtcccagcccagctccacagcaagcctgagtcccaacctcagttgcagaccctgggggcccttgttgaagccttgcggtttcataaaaataatgtcttctgctcctaagtcctctgagaagctactgaaagctatgaattcactgctcagaagttccacctgacaaataccaggcaggggctacagataattttgtgaaattcaaggaaccccttctaggctggcccccaaacctcatcatgctcatgttaagccctgttttgtgtaaaatgtatgaaacgatc

SEQ ID NO: 264224 - DNA, 526 bp, Homo sapiens
cacgaggcctactgtaagttccacaaggcagtgaccagatgggtttcattcatcattatctccccagtgcctatcacagtgcctggcacacagtaggaactcaaatatatttgccaaattgagttgcaaattaatatacatatgctgtggtttactttctttcttttttttttttttttgtctcttttgagtttagtcatcaaaagttagcctctttgaggccaggggtatctgcaggacccagcttgtcacttcacaacagggtgggccaggctcggagcatgagaaacttaccaaagtgatgccgtccggtgggagcgccaggtggccaccagccagcctttccctggtgatgacccaaccttcagccacacacatcgccctcacacgtctgcagtaagcctgggaagtaacatggagaatgcagtgtctcctgcttctgaagcacggcatccctggaggccgatgcagtggccctgggttctggcgcataactagtaaaggagtaaagacagaagtgagggga

SEQ ID NO: 264225 - DNA, 399 bp, Homo sapiens
aatacatacaaaacaacctctagacctatacgatttgtaaatgtttttaaacaaaataccagcacatatttaaaagcattctgcaaaatactggtacatcatgaaaaagtagcttttactccaaaagttcaaggatacttcaaacttaaaaaaacttattaatgcgaaatttataagtagaaggatagaagccaaatgatcagcccaatgcatacagaaatttatttcataaaattccacatgcaattccgatttttttaaaaaatgggtaagttagaaatataaggaatcttcttctaaataatgggttgtttataaaacagctgtcaaaaagatatgtaatagaaaaattagagacaatttcatgtcagtcaggatccagtcagaaatgctcattat

SEQ ID NO: 264226 - DNA, 399 bp, Homo sapiens
tacaaaaaaaaagaaagtcaaggaagaaatcacctgtcgggtttagatatgtagagtcagaaggatgtaatcctagacaaagagaaaggcatggacattggcaagaaaaagcacggggagttcacaaaacgtgtagggctgatctccagccaggagcgcacatttgttgtttagtgtctggtgtctattctgattggttcaaaaagactttgctgaaatggcgtcttccctatggaggcaccccagtcccactaatgcttctccttcccaaaacacttacttaattcttctcatagcacttttatttttataacagatgttgtaatttactcattgattatcctatttactctctgtattttcccattggaataaaagtaagggaaggatctgcatctg

SEQ ID NO: 264227 - DNA, 564 bp, Homo sapiens
caagttcagtggctattcataggcatgatcatggtgcattgcagcctcaaactcctggccccaagtgatcttaccacctcagcctgccaagtagctgtgattataatgagaccatgggttggcgcccctgctcctggcttgtgtatttgttatactttttttttttctagattaaccaattggacttactgtttaaactttgagatactttccctgaaaaggtatatggaaatagaagaaaaacataatgagcatattatatgaatatgtagctagcatacctttaaaattttttatgccttcttgactttacagataccttgtatattaatttgtcttaatttgaaactcatagaacttgtggtttacagtttagtgaatactattagcttaaaggatcttatccaaatgctttatttagattgagatgatttggagaaataagcctttcagaccatcttgcgcttaacttttgtgggtctaggaacaagagtacaaatggagtgtcacataccgtacgtctaatttaaacgttataaatcaatcttaaaaaagaacttgcca

SEQ ID NO: 264228 - DNA, 414 bp, Homo sapiens
agtcaggattccaacccaaatcttgtctaacttcagaatctgcacgcttaaccactacactgcattgcctccagtgactctgggttgataactaagatgaaataagaaggaaatttgtacttctcagtggcaaattttaaaaacatattataaatggagggtattttttagaacatgaacaagtttcatatacatagtcatacaatttttatttccaaatacatgtagtaatggtgaaaatcccacacaatgaatttctcacaatttttcataagtactcaatcatggtgttttttttttttttagacagggtttcgttcttgctgcccaggctagagtgcaacggcagatctcggctcactgcaaccgccccctccctggttcaagcaattctgcctcaacctccagagtagc

SEQ ID NO: 264229 - DNA, 261 bp, Homo sapiens
tagaaatgtggcaccgaaggtaaagacatctgtgaggctctgaaccagcacgtggtggaatatgatgagctcaaggaaacatgatagtgggaggggctgcagtggttccgactttccacatcttaggtaatggtcccctggcacaaggtaagcagagcactgcacactggatccttagccagtgctgaagaccaaattgctggaaattccagatatcctcagagttgactggataatcccaccacaagaggctttttttct

SEQ ID NO: 264230 - DNA, 1237 bp, Homo sapiens
tgatagtgaataagtctcaggagatctgatgggtttatcaggagtttctgcttttgtttctctctcattgtctcttgccgctgccatataagaagtaccttttgcctcccactgtgattctgaggcctccccagccatgtgcaactgtaagtccaatgaaacctctttttctcctcagttttgggtatgtctttatcagcagcgtgaaaatggactaatacgatcaccctcttctttgttctcctttctatttcatcgctaattttttttggcatttggagggtgctatacattgcaaaagttggggactcactaattccactgctcactgtatatcaaggtaatctgtcaggggtttggttttatataagaaacaaatgagtccccagaacatacaagttaagattattcaatcaagggaggcagtcattaccctttaacctctgaaagaaaactgcaagtaggcatcaaactaaccctgagatgggagagagtagaagttcccacacccagtgaattgtaggacattaggtaattattggtgggaagtaaatttgagtggggaactgaatttcaactgacttttatccttgaagatggtgcttctattttctcaaattagaaggttatgaaaattgcatctgaacaacaagttgtattagcataagttctagaagaaactgagaaagcaaggctagtctgaggaaaatttataccgctcacatttcccttctgaattggagaatagaattgaatagcaaaattgtaacctacctttcaaagatgcattttatagtgaagtatattttgtgaacttttatatcttctattcttatttttctattgccctattttaaaatctatcttgaatttattaaatgtatatgtctctgtttatatatttatgagtaatatggtagtctttttggtatcagatgagaacccaacacacacaaatacatactgacacatacaaagatgtttatactgcctcttacatctgtcggaagagagagggttccaagaattcctgtgatgagggcttaaagccaaatatttttgttatcattttatacatatatattttattttttttctatttgggagaagctagaaaacacacattacttttttttgtatcttttctgttttagactaaaatctgctgctattcaaagaataaattgtatctttgtgtattctgatagacataataagtaagttgtgtaagttataa

SEQ ID NO: 264231 - DNA, 1523 bp, Homo sapiens
tcatgattacgtcttatggttctggcattgattaggcccagttaggcagttctcatttgagactggtcttgcggtggcagtcagatggtggctggggctgggaccttagctccagctatttgtggtaacacctactactcatggcctccctgtctctgtgtggcctgctttctcatggcatgattattgggttccaagaatgagcatcccaatggtcctaggaggaagccagcctctgaagtcacatactgctagttttggcttagccacaggcccacttcaagaaaagggaatgtagatgccatgtctggatggaggaagggtcatattataaaaagaaaatgttgaatgggagatctttttgtggccatattagaaatacaatctgacacaatagctgtatcagaatcgtttaaactatagcactgtaggatgactatagttaacaataatatatattttcaaatagctagaagagagaatattgaatgttcccaaaacaaaggaatgataaatgtgtgagatgatggatatgctaattaccactctctgatcactgtgcattgtatgtatcaaaacatcactacgtacctcatgaatatgtacaattattatgtattagttaaaaataaataaaaaataaattttagatcctatatagagactttcactggtttattgaagcaggaataacaaaaagagggaacttactggaatcagattgtttaaattatagaactgatggaatggcagaaaaccagcctcagaaaatgcaaaccaaaaagccagtagaaggtaaagacaatgttggactggctggaggatggacgaggagaaagatgtaatcttcagtgagacagaatctatctgacttcttacctgaaaacatggaggtggtgggaggatgtacatacactgaagagggcttgatatgtgttggtaaccttgtgctttattgaatttacactttgattttgctgcttcttttattgtaataaccactctatcatctcccactgttaaaatctattcatctttaaagagtcagcccaaatgccaatactctctaatgctttgtgggttttgtcagttaaaattgctttctttctccactattcatattacacttttcccttctcttttaaaacttattgcacaatggttagtatttaagtatgtgttaacctgccttatcaacccaaccaggtgtaagttccttgaaggcaagttccttggcttagttttatttccctagagtatctcaaagcaacaggtgctcagacatatttgttgaataaataccaagttagagattctacaaatagtttagtgataaattctgaatgaatatttccttttcgtttctttaaaatccaataaagatcattcttttcccttcacgtgtcattaataaaaagcttttatttgcttattaaaaaatagttccagattaatgattgatattacctcagaatattgaatgaaatgaaacaatgaaacaataaaatctctctaaataatta

SEQ ID NO: 264232 - DNA, 480 bp, Homo sapiens
aggctgagataggggaattgcttgagtccaggagttcaaggctgcagtgagttgtgatcacactacttcactccagcctgggccctatctcttaaaatatatatatgtagagagagagataaataatttatatgccatataattcacctactgagggttacagttcaatgatttttagtatattcatagggttatgcaatcattcccgcaataaattttagaatattttcatcattccaaaaagaaattcttaaggtgctcattttaatggtaaacaaaaaaggacacaaatttgttgtaccatattatcacaactgcacaacactggaagaaaatatgtcaaaatgttaagagtacttcggtgactggagctctaatttttccccctatttctactttttaaatatttttaaagatttctgtaagtagtgtgtatcagtttgctaatgagagaatataaatattaatttttaaaaattg

SEQ ID NO: 264233 - DNA, 499 bp, Homo sapiens
agccataaacagttggaaccaaaagataagccacaattattatagaatgttctaagagagccgctaaaacaaatgaatgaagctttgttttcttggtttcatacaagtacaagctttgtgctaacaccccataatttacagaatttaaaatcttacagtacacagtgaaggtaagtgttggcgtacttactgttagttaataagaatgccaccttttcttattctgataatgaagtctttcataaagcagaattttctgagcatatatctatgtaatatcagggggaggctacattcttattcagctctcaaactattaactctctttttaaaaattgtgatatgtggtcaagaaagcaatacttctttgaaatagtgatatcactccagggctctggcggtgcagcagctgcccaaagattgcctttgctattttaatctgaatcctagacattttgttccataccaagccaaagaaagagagaaagagtgaggaaaa

SEQ ID NO: 264234 - DNA, 250 bp, Homo sapiens
ggggggatcccttggtagcggggacttaggggcatatgcccaaactgtgggacaacaagcaatttgtcccaccctttcaggtctgctcagttcttattttgacctatatgtataatgggagctcttttctggatcatatagtatattggctataaaaacagacattgagaaagagaggaataagcagagaaaaaacagaagagaaatactgatgaaacaagaatagaggaaaggaccaggggatgagttg

SEQ ID NO: 264235 - DNA, 433 bp, Homo sapiens
tctaaaccttaaaaagttgtgcacaagttgaaatttaataagtgaaattgtacagttatatcctgaacctgatgaggattgtcactgcagcactgagcatgttggtgtgggtggtggctggctgtggacctgggagtgtgcagtgatggagtgagggggtgaacaaggatgacgtacttccaaggggtacccgggtcagtgcagtgaatcaggtgtgctcattgcattgaggaagggttggttttaaaaatggaaggcttagggaagaaaatagtgatttataatataatgccattcgggtcaattaaaaatacacagacacaaagcaacatgcattctgcagaatatattctaaaagacactataaaaaagtttctaaaagacactatagaaagaagctataagaaaatatgtctaaaagacactaaatgca

SEQ ID NO: 264236 - DNA, 645 bp, Homo sapiens
aggaatgttatcattcacagggcttccaagtgactgtggaaaatcttgggaggctttgctttggactttgttatccatttagggactggctgttctgaattgttctctgtgctaggccttatctaaaccgcttgccttaaatctttgaccttcatttaaattgctgacactttccccatgtgaaactgtatcataatttcttctgtcttctttaggctagcagcatttccctttcttattcccagaagagctcagagaagcttatttttttagatgagtgatgcataaaaaggaatgtggctgcacaattctaattatttcataaagttctgaggtatttttagggtgttgcaaagtgctaataaaaaataatcatattcatggacatacagagtggaataatagacactggagactccacaaagtgggagggcagtgagggatgagaaattacctgttgggtacatcgtatactactcaggtgacagtcacactaaaagcccagactccaccactgtgcaatatatacatgtaacaaaaatgtaccctttaaatctataaaaaataaatcctttctagcccagtttgctaagggtttttttttttcatgaagaacatttataataaactctttgttctgcataa

SEQ ID NO: 264237 - DNA, 252 bp, Homo sapiens
taatcttatgataatcctgcacatggcagataatttcttaaagtgaatattttttaaatcataaggggaaagatttttaaactaaattaatactcaaggtcatgtgaattgatggataaaattcttcttgaatttgtgtgggaaacttaaatgcacataggctgacaatggacaaaagcagaatatgcctttgagcatgacatagtagaaaatggacaggtttgggagccagagctgcattcaaacttaggc

SEQ ID NO: 264238 - DNA, 1589 bp, Homo sapiens
  misc_feature (935)..(935): n is a, c, g, or t
  misc_feature (1099)..(1099): n is a, c, g, or t
  misc_feature (1170)..(1170): n is a, c, g, or t
tggtagagatggggtctttctgtgttgcctaggctgatcgcaagctcctgggctcaagtgatcctcccatcttggctcccagactgctaggattacaggcacgagacactgtgcccaggcccaaattctgtacttctcccagctattgtgaagcctccgacatggtctgttctgattctgtcacctttctcttccttctcaagccccagtaggggccttgcctctccagcgtaccctgcttttggagatcttgcctccatgtttccattattgatggagggaccgtggcaggactttgctttccaatgtcactattatgtcagcaggctagccctgaaccccacacagtaagaccccttatgtgagggttttacacctacttgatcttattcctctttccaggtgagcaccacacactgacctagctaggctcagggtaaggtagctcttgctcattttggccaggtatttaattacgtgacattcacagtgtgcctttctacttatctttttatccttttcagttcaagaaacgtggctataccaacttgccacagtgcccatcccactttgtagaagactttgatatctgactcacagagaaactcctgccaggagtttatattgtgtgcagctgattcaggcagtaacttccactcagcgagggggtccatttacaaaaaattacttctcttccttttatgcccagtatggttcttaaaatcaaccagacctatctttcaccagcacgacttggttcttttaaaccacagtatttctgcttcttctagttggaaaactttaatatgagattgaagatatgatttgctttctggattgttgtatgctactaaaaccgaagaaagagaaggaaaaatggatgaatcgacggaccatatcaccctggcacctatatcagctcaaaaactgaaggnaatacccctttcctgccctctctttgactaatgctatagactctgagtcagtagttcctggtgggacctgagagtccacattcctgatgagctccaggtgttcccatgctgctgcccctctgaccacacttagaataagaaggcttgaaatgaaatctgagaantcagcctcttgattccaattttaaacatgcaattgattcttgtaatttttcattcttgtcaaaatgcatancagtaagtttgtaatcagtattggcatgcttaaaagaatttaagacttgctatatttgtcattttaatttatttaaactttaaagatttgttcagaacttggaaagattttgcttaagctcataaatttacccactcaggcatatgagatagggtactttgatttataaatgaagtttaaaattaagggaatttaattaagttttcaaaatgagattggttgttttaaggggaatttactttgtgtaacttgagttcatcaaacgctaatccaagttccctgcaaaacctgttctgttttatataacatttactcgttttagaaatagatgagatttgcaaattgaacctaaagacttaaggcaaattatgtatctttttatactttagtaaagaaaaataaaataaatttgaaacaca

SEQ ID NO: 264239 - DNA, 703 bp, Homo sapiens
cacacaaaaaatctatatgcaaatattaatagtagctctattcataatcaccaaatcaacccaaatagccttcaacaggtgaatggataaacaagctctggtatagtcatacaacagactactactcaagaataagaactgctgcatacaacagtgtggatgaatctcaaaggcactgtgttgagtgacagaagccagtctcaaaaggttacatactaaaagattctatgtatatgatattctggaaaaggcaaagttatagggatagagagtagatcagcgattgtgaggaggtaggggttaaagaaggattttactacaaaggtgcaatgcaaggaagttttgggggtgatgaactgtcctgtatcccgattgtggtggcagttacatgaatctatatttgtgttaagatctatagatctgtactccctcaaaaagtaaaaaaaaaaaaaaaaaaaaaaaaaaaggatctcagtaaatttgaaaaattaaagatcaaaaaaggcaaagttatagggatagagagtagatcagcgattgtgaggaggtaggggttaaagaaggattttactacaaaggtgcaatgcaaggaagttttgggggtgatgaactgtcctgtatcccgattgtggtggcagttacatgaatctatatttgtgttaagatctatagatctgtactccctcaaaaagtaaaaaaaaaa

SEQ ID NO: 264240 - DNA, 793 bp, Homo sapiens
agagggagagggggctcattcagcagtgtttggggaggggctgtagtgccctgagcccactacaggcggcccatccctggctggctgctagaacccaggacaacacctcacccccaacccccagcagctcagcaggtgtggaaaagaacaactgctaattgttgcgaagtacttgacaccagggccctgtggcttcaacaccgcacttcccgagcccgcgaggagcgcggtacacactgtctcaagacacgcagcgtcagccctctcccaccctgcgctgcatcctgaatcctaaggtgtcagcacgttgttcatccggacgggctcacaccttcctgagactgtcgcctgctctgccgagtggagtcctggtgtcccagcacagacatctgagcctgctgcttagacacgctgaggatgggagatctggtttccacactcatccctcctccttaggaggcctccccagcgttctggaaacagcctttcgccaggacaaggacaattggtaagaaggtcttaccagagtagcagaaataattaataacagaagcttgggtgaagcacattttttatggctgtttccatctccatgtaatggaataattgacaataagagacacaccccattacaccagaaatgtacttggagaaattaaaacatttcactaaaatacaaaatagacataataataatttatagcttggaactgcagtcctagagaaaaaaaatccccccccccttttttcagaaccgataaagcaaattaaatgcaaattaaacagttactag

SEQ ID NO: 264241 - DNA, 1386 bp, Homo sapiens
gcggggcagagggtccccctttgcccctccacactgcctcgcgcctttcacgcagagttctagaaggaggttctcaggggttcaggaatccgtgcatgtggccagggcggggccgtggacagggaggtgacaagtcttggagcccacagtctccttcactgcacgtgtgtcttcctcccccacagcctgccgccatccagttcccaccccgcggagagcagggcctcgcggccacaccaggcccaggctctgcccgggacgccccctcccaggggtcaggcttggctctgggagaccccagcttcccaggctccggtggggagtggggccaggcgagggtgccctgacgagggtgggcgcggagggagcagccgctgccacagtcggagcagaggaggtcttggcagaggtccgcggggaggagacggctctcctggcctgttttcctccaacactgtcgccgctggctttttgggtacaggcccgtctggccatttctgctgtggcgccggagggtcttgctcagagatgcccagagagcagccctatggcccatccgtcctcgctgggggctgccaccccgtcgcccttttgtccagcgtctgcagctgggagcgacacgcagtgattgacggccgtggctttgacgccacgtgtgtaaataggctgtggctacggtgggtgggtcggagcccaggaggcagctggggggacctggctatggcctttcctgctgttaggtggctgcaaggcttccattgtgtggttatgtgggtccttgaatgattttggggaggtttccagctcagaatgatgcagaaatgataagactcaaagcaggggccaggccaggccagtgccttcgcctctcccggctgctggtgggcacggaggaaccagggcacatctgtggtacccagggacgtcccttgtcagcccgtttgccacacattgttcctcttgtccaggggagggtggaggagctgcttcccaggactggaggagcagctgggcccctgctgcacgtccggtgggacacacctgtgagccctccagagggagagtgcaggccccttctgagcctggtgttgcagggctccgctctctcccggaagccagggcacccagggcggaggctcctcaggccggggaggcggggagggtgccctgcatggagagagacgccggcgctccccgccttctctgatgctcacccctcccaggccccgttctccctggggtcccccgtttagtagcccccctgcactctttgatatcttagtgtctgaggttgactgtgggtaaatctttaagacactccccagctgtgtttgtttataaatgctgtttatagtgcaataaaggtgtttcgggaataaaaaggtg

SEQ ID NO: 264242 - DNA, 178 bp, Homo sapiens
ggaaagtccctttgaagaggaacctctacttcattttctacagagtgggacagaggtgctggtggaagacagtgatattgatgatcctgaccctgtgtaggcctggctaatgtgtgtgtttgtgtcttgtttttaacaaaaaagtttaaaaagacaataaaaattttaaaccagaaaa

SEQ ID NO: 264243 - DNA, 114 bp, Homo sapiens
ctgtgactgtttcttggtcttatctattgttcccttcccactgcagctgcacccaatcaggtaggtcctcactggctcttccttgatctcacttgaaaccttctaacatatccc

SEQ ID NO: 264244 - DNA, 408 bp, Homo sapiens
ccatcaagcatgcgacaaataatgaagtccacactccaaactcaggagtagactgggacagtcagtgaggtaacagagtttgggaatcgaaatctcaacaagaaaatccaggtggataggtatagggaaattctagtttgaatgctctaaaaattacaaaatactcctatatttggatatctagaggtggcggttttggctttgttttagcaaaaataaagtacctaacttttcctgtgcacacaattatccaagcaattatcacaaatccttgctttccagaagaatgggctgaaggctgacgtttgtgtttattttccagaaagttgcacatttctagcctcaaccttgaaagaaatggacccaataagcccaagcaagcctgacatggcagcaagcactgagaaa

SEQ ID NO: 264245 - DNA, 447 bp, Homo sapiens
aaaaaatgttttaaaagcatttaaaagcagaagttatacatatactaacaatttaagatattatttcaaaaacactttaaaacatacactagactttgcacatcttggtcactagccccatgtgccctgggtgcctcgactttgcacctggttaaaggcttccttggttgggaacaggccacccttccctggcagcattccatttgtccactgacatcctcaggctgaatccattgttcttttcctcctgatcctctgtttatatacttagaatgttaattacaacattgtttcctgtgtagtacatacatattattctttccagccagttgtaagtttcctgagggttaggaacagatcttacttgccctcagactttgtacagggccttggtataaagctggtgtcgcatatttgttgcatctgcaacaggttttattattttct

SEQ ID NO: 264246 - DNA, 408 bp, Homo sapiens
aaagacaaaacaaaaaatcagagtggcttagactagggttcagacatgaagacagagagattttgtattaagaatatatttctaatataattcataggacttggtgattaactaatgtgaaagcaaaaaatgtcagataaagactgaaaaactcataacatttgaagttttggttaatgaacgcaaataaaaaggaggcgtctgggaagaagtgccagagatacagaaataaatttttaatgggtaatcacgaagaagacaggtataaattatgtgtaactcaaatctttctgtttactttttccttctgataggatgaccccagctaacttacagaatttggttttattttctgtcctgtgtttatagagatcggactttcttcaccgcttcttcctcccaccaggg

SEQ ID NO: 264247 - DNA, 563 bp, Homo sapiens
caacccctttaccccttgccagttgatgatgatttgatgcattggtatgtttccaggccactctcagggatctgaaattcttggctagacagggaagagcatttgagcctgcccgtgcacttgcactgccaggactagcaagcagtgccaaggtttgcctgatcacttgtccccatccttgatggggacaagaaaactaaaggaatttttcttttgatggcaaaagaaaactaaaggaagactgatacattccatatcagatacccatgttgcactctaaattactctcctcagatactttaaacccttcacagctggagttttccattatctaagcacttgtaatatttggaaagaaaaaccataaccaatctcaaaacaaccatgattcactcccccacaaaaaatgaaaaattaatcttaattttaaaatattttgttcttatacattacagtacacttggaatttcattcaactttctgttttacacggtattactgggtgaacaaaaggctttctggctctgagggtatcttcaaagacgggacttttaccttatacc

SEQ ID NO: 264248 - DNA, 603 bp, Homo sapiens
gtcggaggggagatgactgccaccagcaatcgtggtaactgggaggatcttgaggtgccctcattaaatagcacccagtgttaaagaggaggccaagaagcttctcatcgtcttgagggaaggccactgcaggagctggagaatgcaacagaagcttgtaaggactaagcccagatctgagaaggagtcatacagctgctctgccctgccttcggggagtggagaggagactgaagtccagaaaggtagatgcatttgtccaacttcacacagagcactatggtgaacaagggctgagacgcagaacaccgcaggcgacttcttgccaagctgcctgctagttcacctccccagagggtgtgtacaccaacgtgcacgcagaagtacaccagaagtacacggttgcctctggcgctctgctctttacactgctgagaatgtatgtttgctccattgttgaaaattcctttctcttcatgttcatctcagatgtctggagcggtctcagtccgttcgtaaagacaggaacatctgctctttgtcaaactgccctgatgcttgcccgccccaaagaggaatcatatcacgctcatcttttccgtg

SEQ ID NO: 264249 - DNA, 323 bp, Homo sapiens
ttttttggaagccaaaatgatttacattgaaaattaaattactgaataaaatacatggtatgaagctaaaatggtttataataggtgaatagtagtgatagaatttccttctcagaaacgagaaatatatatgctaaaaccatttctgaatgaacttccaaaactattaacatcattcatttaaatactttgatatcaagatgacaccaacttaaatactggttctgacagtttattccatttatataagatatcacaaggagaaatttagaaacattctgatgaacccaaatgagaaacctcaatatagcttttcaactaat

SEQ ID NO: 264250 - DNA, 528 bp, Homo sapiens
atttttggtgtttaatgacaatgtggtgtgtgtacacaactgaatattattcagctatgaaaacgaaggaaatcctgtcatgtgtgacaacgtggatgaacccaaagtcattatgttaagtgaaacgacccaggcacagaaagacagatactgcatgtcactcatatgtggatctaaaactgtcacaactcacagaaacagaataggacagtggttgccaggggctgggggaatgcagactgtggcgatgctgattaaaggtgtaacttcccgtcacaaggtgaagttctgaaggtctgataaacagcatggtggctagagttaatattatacagcatggtggctacagttaaaatcatacagtacggtggctatcagttaatataacttgaaatttgcgaagagagtagaccttaggtgtctgtatctccaaaaaaaaggataattgtatgaggtgatagatgtgtattaagttgattgtgtcatcagttcacaaaataaatcatcacgctgtacaccttaaaaaaa

SEQ ID NO: 264251 - DNA, 556 bp, Homo sapiens
atttttggtgtttaatgacaatgtggtgtgtgtacacaactgaatattattcagctatgaaaacgaaggaaatcctgtcatgtgtgacaacgtggatgaacccaaagtcattatgttaagtgaaacgacccaggcacagaaagacagatactgcatgtcactcatatgtggatctaaaactgtcacaactcacagaaacagaataggacagtggttgccaggggctgggggaatgcagactgtggcgatgctgattaaaggtgtaacttcccgtcacaaggtgaagttctgaaggtctgataaacagcatggtggctagagttaatgttatagagcatggtggccagagttaacattatacagcatggtggctacagttaaaatcatacagtacggtggctatcagttaatataacttgaaatttgcgaagagagtagaccttaggtgtctgtatctccaaaaaaaaggataattgtatgaggtgatagatgtgtattaagttgattgtgtcatcagttcacaaaataaatcatcacgctgtacaccttaaaaaaa

SEQ ID NO: 264252 - DNA, 635 bp, Homo sapiens
cagtggtgagtacagtcagcggccctgggccagggaatactgtgctggctctggcagggcctggttgtatgtttatgaaaccaggagcacagcctagggaaacttaaagcaagctgccagaggaggctgcaaattgatctgttaaatcgcagatcaccaaacagaacctgtcccacctctatgcttacttctggcgaggttctgattggaaggaagtgctgtcacccaaggaaccccgtaactccgaggggcaggcacatgagcttctaagggtgtgtgtaaatttatacttcagtcacagctaaagtctggccttctaggaaaactatcccccacccctttcccaaacttcccacgaagccctccaaccacaaaaaaacaactttagaaacttgagtggggcttttctggaatcaggttccctcagttacagtgaaggcagatatctagatactttatcccacactttcccttaagtcatgaggtgcctgtttcagttgcctcttcgctctagttgctgcctccacccccaccccccatgaaactgggggagaggaaggtccttcatgtcctactgcatgccttctatatgctaggcactattctagcactggggatacagctatgagcaaaac

SEQ ID NO: 264253 - DNA, 627 bp, Homo sapiens
atgggaattgtaggctcatccatttctgaaagtaatgtgtgtgtcaaaagtaaaaaaaaaagtcttatctcctataaattatacatctcatttgatttactgtttaatgctgattttaaaagctaagattttaaataacttaaaaagaccaatgaggctgggcgtggtggctcacgcctgtaatcccagcactttgggaggcagaggcgggcggatcacaaggtcagatcaagaccatcctggctaacacagtgaaaccccatctctactaaaaatacaaaaaaaaaaaaaaaaaaaaattcagccgggcatggtggtgggcacctgtagtcccagctactcgggaggctgaggcaggagaattgcatgaacccgagaggcggagtcgctgcaacctgcacctcctgggttcaagggatcctcctgcctcggcctcctgagtagtggggactacaggtgtacaccaccacacctggctaatttttgtacttttagtagagatgggatttcaccatgttgtccaggctgctctcgaccgtgcccggacaaaaaaaactatttttctactctggttgactagcagaggaagccataaggtagctgtataccaaaaaaaatggtcctgca

SEQ ID NO: 264254 - DNA, 1017 bp, Homo sapiens
tactactaaattcgcggccgctcgacctcagacacccaaggagagagactgcgaggaaagaaacagagtcatgatagttgtacctctatttccctaagtactatctaagtatatttcttcctatggacacccacttccagattctacttctgcagggttccacagaagtctccaatcttcaaatcttcagtgtatgaaagcacagattcctgaaagaatggcctcaaatgaccagaagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagaggtgaggagacacctgtcctgtgccacacatctatgtagttcagcaatttccagccccttagtactccaggggctctaagccacccctttgtaagtcaggatggaagtagatgacaccacatttctatctgctgtagacattcttcccagtgtctcaaaatgttttggcatctttcagtaaaaatcttcaagtttgtcagtccttgatttaaaaaaaaaaagcagcaaaatttttagagctcccttgaaccttctattttaatgtgcctttgtagataattcccaacatcttgtgtccttcatttttataatttatctttatcaaacttgtcataaaccccaatactttgatctcttgtagaagagtccgtactcctatccagtccagtgttgtttatcttcaaacttggacttcccctgctcattccattcttatctacttccattgggttcaccagctaattccattctcattctatccacaggctcactcccgtttgtattattaaaacacacgccaataggacataaaaagaagcaagagtactgggctttaccatgagttcaaatctcatttctgccaattcctatgtct

SEQ ID NO: 264255 - DNA, 541 bp, Homo sapiens
tcctaagtaatttgcatttttatcattagcaaaataatagaatcacattttttacattggaacatagataaaacaacaagtcttccacagttctgctgctctaacacagccaagtattttcatgcatttctaagaggaaacagctgatgttttaggaggaggggttgtgttgggcacagagagtccagtgctggatatggtgcccagtgaagaaatggtgccatctttcctctagtaaggataaggacaggtctacccaggcccattactccacattcactctggtacacacatgctgcttaactaatcacccaggaattcagattccaaaagacacatgttcttgctcaggtgcacacagaagagcacaccacacatacacacctgtgctcctgtctgtctttggtccctttcagagttgagagatcaggagaaaagatagccaggttcagaagtgtgtgctgtcactgtagggatggacgccaggtagtctaaggaggagacctttttcctaagcagggaaaaaacaaaacaaaacaaa

SEQ ID NO: 264256 - DNA, 216 bp, Homo sapiens
aacaaacaaaacccaaacatagacagtcatttccgttttcctgctgagattctttacaaagagagaattatttttatatttagtaagaataagaatccaagaatccctggggagtttttaaaatgcagattcctcggtcctcctacctctgcggtattcaccagctcccctcccagcctcagaagggtggttcttatgggctgggcacagtggctt

SEQ ID NO: 264257 - DNA, 401 bp, Homo sapiens
tgagacaaagtagattagtgattgtcagggtctaggaggaggagaataggaagtgactactgagagtgggttttctttttgggggatgaaaatgttccaggctgggcgtggtgggtcacgcctgtaatcccagcactttgggaggccgaggtgggcggatcacaaggtcaagagatccagaccatcctggccaacgtggtgaaaccccgtccctactaaaaatacaaaaaaaattagctgggcacggtggcgtgcacctgtagtcccagctactcaggaagctgaggcaggagaatcacttgaacccgagaggcggaggttgcagtgagctgagatcacgctactgcactccagcctgggtgacagagtgagagcgagactccatctccaaaaaaaaaaaa

SEQ ID NO: 264258 - DNA, 299 bp, Homo sapiens
agtaaaacaaaaaaacctttcaacaagcaacatcacttaagtagttttgagggtagagcaaaaaaaaaaaaaatatatatatatatgtatgccaaatatgtccccattttaaataaattttttttcatttcaataatgaatcaaagatcatttgtaattgcctaatttgataattttcagggtggttccatagcagaaatgccccaaaacagtgaatcaggagcatcaggctggctgaagaccaagggcagcgggtagagccagggcccggggacatgctcctctgagtggctctgtgt

SEQ ID NO: 264259 - DNA, 277 bp, Homo sapiens
caaaatgacagagaccaatgtgctcagtcttggtagaactatgacatgagagatcaccagataacagctgtcagacagaaccagcttcttttcaatggtataattgtccatctcatccatcgtgaaaacttaagcataagttaagcataagtcttacatacattatgtccaccttttattactgttgttaactacaaaacagagctaaagagaacagaacagaaagtcccacaatttcctggctgacaaaaataaaattaatacatgtgtgcttaaa

SEQ ID NO: 264260 - DNA, 336 bp, Homo sapiens
ccccgcaaaactgcagcacaaaagaatttcagatccacccactcagaagtctgaagccagtgtggctcgccctcactgatctcagggtctgcatttgcaatgtaccaagacagacctgatcataaaaccaataacaaagaatgtcagaagtcttttacatggattaagaaaaaaatgcgagcaagaaggcctaagaaaggagaggtttcaatagatggtacactcggttgttcccttagaccacctttgttagtcttcgcctcaaagaaaaacatttccactgaaaaccacataatctggtttaacagattaaatatataaactatgatgtgctgg

SEQ ID NO: 264261 - DNA, 255 bp, Homo sapiens
ggtagaatatactataatatggatcatctctacttctgtatttatttatttattactagacctcaaccacatgtcttctttttccccttccacctctctttgcctgtaagatgtactgtatgtagtcatgcactttgtattaatatattagaaatctacagatctgttttgtactttttatactgttggatacttataatcaaaacttttactagggtattgaataaatctagtcttattagaaaataaaaaata

SEQ ID NO: 264262 - DNA, 342 bp, Homo sapiens
agatgctggagaactccttgtgcagccccacctgggaaggatcccagttctgggtaacggtgcagaggactgaggcggtcgagcactgtggcctgcatgcctcctacgtgctgagggtggaggctgaaaggctgactctcctgaccatgggagcccagagtcaggtaccggagctgctcctgtcctggccctacactctgttgcattgctatggccgggacaaggtcatgttctcttttgaggccagcgccgctgcctcttgggccctggaaccttcctttccagacggcacagggaaatgacatcttccaggcagatgagactgccatccaccggcagaag

SEQ ID NO: 264263 - DNA, 332 bp, Homo sapiens
gcaaagtccctgttcagtccttgggaagcatcaccactgctacatttctgatgttctgaagatgggttagaacagagcggccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggtggagcttgcagtgagtcgagatcgcgccactgcactccagcc

SEQ ID NO: 264264 - DNA, 399 bp, Homo sapiens
ccatgccacccctgagggcacggtgatggagaagatatgcttcctgcctccaagaaccccatagtctagtggcagagacaagcaggtacatagctgcctatagtacagcatcacaggtgccataacattgtgtaaactgggaataattctattctctggatatagaacatctaaccaagatattgagtatctggcttccccttccccacactggccctcactgggatccatgtctaatattatgaaagtcacacaatatcattataaactaatcataaatggcactgtcagtttgctacaaaaacttattcagaaaatattcagattctcccatcaacatatgccgctatgttggcaaaagctctgatttaaaatacttatttcgttttcctctccgat

SEQ ID NO: 264265 - DNA, 469 bp, Homo sapiens
gccacagtgctctccatcctcccagctggcagagatctctcctgctccccctgtggctcttcttgtatggaccgcggctggcaaattagcctctttccacccctcctagcatttttataatccaccctcccctgcagcacctagcccagtgtcctcaggtagggggaggtggggaaataatagatatccctgcagttgcatttagtgtgtgtgtgatgtgtgtgtcactttctgtaaaatgggttcttgcaggctcacctcactgacaggtccccacaatcctggcagctccaggactgtcagtcagctgctggcctttccagatgctcgtaggggtcttccatgcttcatggagaaatggctgtgagcactactcagtcatggcaattaaagaaacaggcactaaatttaaagggaacactgaaaggtagcctagaaaatgataccttagtggagcatgtttttctga

SEQ ID NO: 264266 - DNA, 441 bp, Homo sapiens
agatgatcatatggtttttgtcttttatcttattgatatgatgtattacattagttgatttttggatgttaaaccaaccttgtattaggaataaatcctacttggttgtggtgtataatattgaggagagaagccatttctctgactgtctcctgtctctgaagaggaggaggaagtaaaagttgaaaaacaacaggaatgaagtcagtggcaagaccagccggtgccactgatgacctgacctgaggttaaaagattaactcccccactctaaccacatgtgctctcaatcaatcacgaccctttcacgtggaactccttagagttgtaagcccttaaaagggccaggaactctgtcttcagggagctcggctcttaaacgacgcgagtctgccaacgctcctggccgaataaaaaacctcttccttctttaatccggtg

SEQ ID NO: 264267 - DNA, 306 bp, Homo sapiens
atgtcagacgcagccgtagacaccagctccgaaatcaccaccgaggacttaaaggagaagaaggaagttgtggaagaggcggaaaatggaagagacgcccctgctgacgaggaaaatggggagcaagaggctgacaatgaagtagatgaagaacaggaagaaggtggggaggaagaaggtgatggtgaggaagaggatggagatgaagatgagggagctgagtcagctacggacaagcgggcagctgaagatgatgaggataacgatgtcgataccaagaagcagaagaccgacgaggatgactag

SEQ ID NO: 264268 - DNA, 298 bp, Homo sapiens
tatagaaataacttttcaaaaagttaatcagttggttagtcagcacaatacattaactatttcccccactgatttgaggaacttattatcatatactgaatatatgagccaccgcacccggcccatttggtgattttcttgctactctttattttaatgagtaccttacagcagtgcttgaagtattttcaaagtattccacttaaatgtcataaagtaaatgaagataaacttttcattaaaatactttagaaatttttgcatttatgttgcaataaaagaaaacttgccatacacc

SEQ ID NO: 264269 - DNA, 159 bp, Homo sapiens
cactccgttatttctttgatctcctagggcattctgatggtcatagtaattttgaaggccaggctcttccttcctctgaattgggtcggtgaaccttcttgctgtccccatgaagggtccctgttatgttccatgacagcccagatctggaactcagtc

SEQ ID NO: 264270 - DNA, 416 bp, Homo sapiens
agatttacttttcttttctaccttcctcagaggctgcatgacataccaattcttatggaaggactcagtgctcaccatcctcgaaaacctgattcaaaacctatcttgccattcttgcgtgctcctaaaagaagagaaaaaggcctccagttagaggccatcaacaaaaatgctgaatgggtcatcgtatttcctaaaagtcaagaacaaagaagacccagacaaggcttctgagaactatggagacgtatccagatgccacactgaaaatacaattccaccacccatccattatttgctcaggcatataacaagacatctcttttcactggtttctcttctgccacctgttaaattagaaaaacaactagtcttataaatgaataaaggtgcttattatagatacataccacttc

SEQ ID NO: 264271 - DNA, 384 bp, Homo sapiens
tccctgaggctcagcttcagttagaggccaaggttaagagatgcccctcagcagcagtcagtagtcaggaccagattaaaaagtgcacggcagatgaaaatacccacacttcatgctgaaacatttccagggatctacatagctctcaggatgaaaactagagcccttgcctatggcccacaagggctgtgggatggcacctgtctccttagcctcacaggctcaccctgccccatccccaacccctattcagggccttgcaactgaacttgcctctgccacgtgtgctttctttccactctcctgtcatctcctttcatccattctaattttaatattccaggctccagagccacacttcttgacattctatcctggctctgt

SEQ ID NO: 264272 - DNA, 627 bp, Homo sapiens
gaccaacctggccaacatggcaaaaccccgtctttgctaaaaatacaaaaattagctggccgtggtggtgcacgcctatagtcccagatactcaggagactaaggcaagagagtcacttgaacccgggagacagaggttgcagtgagcggagattgcaccactgcactccagcctgggtgacacagcgagacaccgcttcaaaaaaagaaatgttttggtgggaaaaaaaagtcacagaagacacaaatgctgaggagactgtgccaggaatacatgttagaggtctttggcagacaggcaaccggctgtagctattcttttcttttctttttttttttttttttttttttttttttgagacagaatctggctctgtcgcccaggctgcagggcagtagcgcgatctcggttcactgcaacctctgccacctgagtagccaggattataggtacctgccactacacccagctaatttttttttttttttaagtagagacggggttttgccatgttagccaggctagtctcgaactcctgacctcaggtgatccacccgcctcggcctcccacagtgctgggattacaggcgtgagcaccgtgccttgcctattcttacagagatcac

SEQ ID NO: 264273 - DNA, 981 bp, Homo sapiens
gaacaggaaagtaatacctggtggagcatttaaatgccatggcagagttaagtatcttccttttttctcttcttcatatggtgatttttttttcacaaagaaggatatcattggaatcaactgaagatgctagattaagaaagattaagtacactgccatgtaactcagatatttttgtatagtaccgacataacagaatggtatcaatgcagttgaatttcagtagcataccagctgcttccggaaggaggggaatttattctttctctctttgctatggactactatgcactttagcatcttcaggacaaataagggacaactagcagagaatgactatgcccggaagtagaacaggaaagtaatacctggtggagcatttaaatgccatggcagagttaagtatcttccttttttctcttcttcatatggtgatttttttttcacagagaaggatatcattggaatcaactgaagatgctagattaagaaagattaagtacactgccatctaactcagatatttttgtatagtaccgacataacagaatggtatcaatgcagttgaatttcagtagcataccagctgcttccatagccttaggaaaaataattaaataagcagtgttttctaccagttcttcctactttggtctcttgtattacctttttatcaccatcttttacctttagattgccctaagcacttcatcaggtttgtcccacaccaggtatctcttactctcaaatcatgttttcctctcttgccagtagaaagattctttaccactagaagtttccaagttatcatttatttcctttctaaaaatggaagtaaaaagggggagcagaggaaaacctagcttgagttagagtattaaaccatgtgaaatcatacttgtttgtttatgatattaactcctcatacctgcttctttcattttttcattaaagtgactctgactctagtacccagtaaa

SEQ ID NO: 264274 - DNA, 540 bp, Homo sapiens
taaagtaactgttcatttgagttatttacagctaaaaccacattatgtttttctggagcataatgtttgtgttttctagttatcgtaccaaagtaaacagtaatatctttagcttaagaacccaactgaaatgtttgtaaaatatagattgttttgtaatttggctctttttttttaatggtcctatgaatgcaactatagtgtttgcagtatttgtacagtgcatggggtgctttttctgggtgctgagaagggaggagaaatgatagggaagaggggatttggagtagccgaaggaaaaaatgtgcaatcagtgttgttgattccaccgaattctaagaattccattacatcttgatatctggtacaagctcaaagttaatcttaaattttggcttagggcatggccgtacttgctggctacttgggaggctaaagcaggaggatccttagagcctggaaggtcaaggctgctgtgagccatgaccgtgccactgcactccagcctgagtgacagagtgagaccctgtctttaaaaag

SEQ ID NO: 264275 - DNA, 538 bp, Homo sapiens
ggagtgattgataaaatcttcatattaagtaaaaatgcatattttgtatctaagtaagtttagtttaaaaacaataccaaagtatgccctaatgggagcaattactatcctaatgcactaaaatgtagactagatataaagatatagatgctacttagaaatcatttaatccaacctcctaatttttcagatgaagagaccaaggcccacagaggtgcctttgatttgcccaggtcctattagttagtggctcaggtggaccagaatgcaaatctctttatgctccacctgtttcattttccaaaatacctattcctcactgtaccactctgatggccaggaggaagtacattccacaatggtgaacagtttgcacttaaaagagagctctattgaaggtatgcactcaatacattgttgatttggatttaatttttagataggagagccaagcctaacagtagtaaataaatacctcaatagtaccagaaaaacacttttcttccattagattgagttctaaaggaccatataaacc

SEQ ID NO: 264276 - DNA, 794 bp, Homo sapiens
cgctcctggttcagccgcctctgcctgcgagacggttcaattcctgcgtgcggacgtttgttttgttggaccttgacctgactaggaaatttccctctctcattgcagtttcgggcatcctcgtccggagcacgctgggcgtggcatggctaaggctcagccttcgaactttgtatcaaaggcgtgtgaggagccagagtcccaggccggaagtcataagtgcgaaggggcgtttctctgcacggtgtgcttagtttttgttaatactgcaccataagcggaaaatagactcgggaactgattgaggttactttgaacgcaccaagatttttttccggtctctggtttgtgtcttaatttccatactgttaatgttttagggaaacgtaataatggtgcattattgtcctcgttttgtttgaaaatcagatcttcacataattttgggttgggtagttggggttcagaggaaattggcaagagggctggggtttttcggggacgtcagcgttgccattccaagcatgctgcccagaactgctgtagatgggaagagaaagctgctctaatgtgtccgcagccctctcaagtgctaccatataattcgcgtcttgtttggcctcaagacagttggcctcacaatagatataagatgtggtttagtagacacctcgtccagtggataggaggatgctctcatggactggacacatcaagtttttagcctgtttaattaaacctagaaaaattgttacattttagaaagtttttattgatgataaaatgttctctga

SEQ ID NO: 264277 - DNA, 554 bp, Homo sapiens
atgcaagtcattggatgggcatatgcatatgttttcatttatcttgggtagatttcaaagagtggaattgctggatcatatggtaacatgaactgtttaagaagctgccaacttttttccaaagtttgtgtattaatttacattttcatcaacaatatttgaaggttccagtttttcatattttcgccaatatttgtattatcagtctctttgattatagttgttctagcggtatatagtagtgtggtttttcttttatggatagtgtttttggtgttatatgtaaaaattctttgcctaactcaaaggtcacagatatttttttctgttttctgttagaagttttatagtttttaagctttatgtttaggtccattttgagttaatttttttatgtgtggtatacagtaagggtcttcattctttgctttgcatgtgggtatccagttgttcctgcatcatttgttgaagactattctccacccactgaattaccatgacatctttgtcaaaaattaattgaccataaatataagagtttatttcctgacttt

SEQ ID NO: 264278 - DNA, 349 bp, Homo sapiens
ctatggttctgtggtagcctccagttgctaccaaattataaaaagctttcagttaccctcccagataactgatatcatccttagcctgcaggacagctatgcaaatctgaaggtcaactatccacaatatatgctttggtcttaaagtcactcctttcagttttgaaccaaattcataccttttgctttcaaaacactcgaggactccccacctgccttctgaagtctgaaattttctctaagtaatcctgattttgcacctgttacttcgatcactccattacccttagcacttgttattgtacttcctgtgcaagttttgtggattattaaatgtctttcacaaatg

SEQ ID NO: 264279 - DNA, 283 bp, Homo sapiens
tttctaaacatatataaggtaaagagaataatataatggacttaatgtatgcatcacttggcttcagcaattctccttttataaaatgcattccaaacccttaccctcttctgcctctttcagcaaatttgtttgaggtggtggatgtttgctgagtggacggatgaaaaaaaatagttgaagagtaattgccatttgatacagaacagaagagcttagctttggtttaagctgttcatttccctcccacagtctgaagttcagctgcaggaaaaaaaaataa

SEQ ID NO: 264280 - DNA, 144 bp, Homo sapiens
ttatttttgcaagactgaaccatgtatacctgctttgagatcaaacagaaagctaactccaaaagggcaatcctatagctatcccagaagagcatgttttgcttgctgggatgaaatgtgaatatattttatgaatatggactt

SEQ ID NO: 264281 - DNA, 466 bp, Homo sapiens
cttgttctaggtttcagagtacctgaaatactgtaagtatctcatcatgctgaatgagactctggtgtctaaagatttgaattaccactgaacatacccccaaatataagctaactgtatcatttgaaactcaacatgagaaaccaccacaggaacacctttcgaaactcagcaggtttcaacaagggaggaaagactgactgtgttggacttaaagaaaggaagctcatggctctctaacaagatgccttcccatgagattcttgaagataattttgccctaatgattttcacctcacccactgactacagaactgagtcttcatgtaaactgagatattgccgtagcctttaaaagcatcccacaaagaaaaacattaataatccagtctaaaattttcagatttgaaaacatgggtatgtgtttgtatatgtcatgctaaatataactgatataaagttcatg

SEQ ID NO: 264282 - DNA, 152 bp, Homo sapiens
cagaaggagacgccccttccagtctctctaccatctgataaaacaatggtcatggaggcactatcattagctaaaagttctagtcatctatcacccagtgaagaagtgagatgcactcaggatttcctttcacagactcagagtctcctcgg

SEQ ID NO: 264283 - DNA, 402 bp, Homo sapiens
agtccctcctgccgccccgcgggccctggcgctgccgtctccccaaagccacagaggcccttccagcagcagaaaaccctctacagttcgtcccaccctggacaaggtgggcagcccaggccagagtgacatagttcccacgtttttcccagaagttcgacagtttttaagcatccgtgcctctcaaatttgtgttaagcctttgctcaatttctacagtatggaaatggatgattttgttcattttttttcagctttgtgcttgcctatttggaagacaatttcctgatctcatttagcaatagctaaaagtgctatctctttttttcacaaatcttttttaagtaaactgcatacaatactgaaaataaaaataaaatacgaatccatcatgacaatacc

SEQ ID NO: 264284 - DNA, 682 bp, Homo sapiens
aacaaatatgtaatgattattatgtttcttttttttttgaggtggaatctcactctgtcacccaggctgaagtgcagtgaccgcaatctgagctcactgcaacctccaccacctgggttcaagtgattctcctctttcagcctccgaaatagctgagattacaggtgcgcaccaccatgcccagctaattttttgtgtttttggtagagatggggttgcaccatattggccaggctggtctggaactcctgagctcaactgatccacttgcctcagcctcccaaagtgctatgattactatgtttctgacatgcgaagtggcaaatatatgacatatgttaagatctcaggaaaccagaattttagagtaataacatttccattttctcactcttcagaaacacttattttttttttagtggcatcttgccctcagaactccactcaggaaagtaatacaagtataattatttttattttatatatgaagatgcaatcatggaatggatttgaagacttaatccaaattacagagcaagataacaccaataccaggaattaaacccatatattttcactcaatcttggcaacacttctatggattattaatgtaataagaataaggtttacaattattaaactatttcaaccccgtacgtgtgttgaatggcagtcatcaaa

SEQ ID NO: 264285 - DNA, 241 bp, Homo sapiens
atctgttattcaaatactgaatgttacagtcattgattttagtgaagaatcaggaatttttaaaatatctgcataagaatgacaaataacagggaatatgttttttgtctaccagggtcagtttggtctgagggtggaggaatgagatagagaaggtagagggagagagatcaagaaaaagaaagagaaaaaagaggtataaggagaaaatgcaaaactcagttaatatgtcataatcagg

SEQ ID NO: 264286 - DNA, 404 bp, Homo sapiens
tggtacacagagacgaggaagtgggcagaaaggtgactgattaggctccctcagcgtacgttatcacatcattctattcccaggttgctatggtgcttcctataatccaagttgcttatagacagtgtgcatggagctttctcaacctgccttgctcacctctttgctttctcaacctgcattgctcaacctgcagtctgcaactctttgtggccatggacagaagctcagaccgagagctctctgcgattctgtgattcagagaccgaacttgtgtgtgaccatctccttgaactccttgatttctagcctgagaaatgaaagtgtgaaacaagcttcacataaaatatttaaagaacaaactttattcatgaaaataaatgagaagatgatgaacttctaaa

SEQ ID NO: 264287 - DNA, 602 bp, Homo sapiens
gcggtggctcacacctgtaatcccagcactttgggaggctgaggtgggcagatcacttgaggttagggattcgagaccagcctggccaacatggtgaaacctgtctctactaaaaacgcaaaaattagccaggcatgatggtgggcacctgtgatcccagttactcaggaggctgaggtgggagaatcgcttgaacctgggaggcaaaagttgcagtgagccgagatagtaccactgcactccagcctgggtgacagaacaagactctgtctcaataataataataataatgatgataataatatttttcattacccttttaaaattcatgggatcagtagtgatggttcttttgtcattttcaatattaatgctttgggtcttctctctttttttctcaggtaacttggctagaggtttagcaattttattagtcttttcaaagaatcaactttttattgatttccagtttttcttactttaaactatatgcattcaatgctgtaaaattttcctctaagcactgcttcacttcatcccatatactttgattaagcatattttatttttaatttttaattgaaatagaatattttaaaatt

SEQ ID NO: 264288 - DNA, 249 bp, Homo sapiens
accctgtcaaaaaaaaaaaaaaaacactaacaaaatgggcttcatcaaaatgaaaaactcccactcattacaagatattattatgagaatgatatggaaataatctcaatgtccattgtcagatgaacaaataaagaaagtgtggtaaacacacacaatgaaaaaacatttgttcttaaaaaggaaggaaatcctgccatttgtgactacatacacagacctggagggcattatgttaaatgaaacaag

SEQ ID NO: 264289 - DNA, 434 bp, Homo sapiens
gggcaaactatgttacatggattcttctagtaatgtgcctggaaatggaagctgagcaatttgcaatcacctcatgtgttccagtactaaaaaagcctctatataattgcaatgcaattgaatatgtttaaaaaactaatacaagtagaatggttaaagacctcaactaagaacattttggatgaatttataaaatacgcctttactttagaaattaatgcactttgtttagctcatgagaagatgaattttcttaagctatgattaagaatacatttaaattaaaatgcactcataagatagaacatgagaacttaaaagtctcatccaacttaaaacattcaatggaagtaatttcttttgtctacttaaacatagtttatggcatctatattgtgctagagggacaataacaaagtttgtaactcaatgag

SEQ ID NO: 264290 - DNA, 452 bp, Homo sapiens
agcaattaaagcataaaaagtagatctaagattttctaaatattagatattctaaaatattgacattatacaatgtctagcatccgtaacttttgaagatattttatttcaaggtaatttcataagaattcataagaatttacctactcagactttgggcaggatggaaaatagagtttctgtgaggtgtgcctatgaatcataagaagggcttcttaatgaggtcagtaattaaggaaatacatttcaatagtgacatttgacttacaacattgtttgggggtggagtcttagaagaattgatagggaacttttaacttcaacaagtgaaactaaaacattaactccagttgttgttacctaatacaagaccagtgcccaataaggactttggaattctttcataacaactccttggcaggtgcacttcacttgttctggaagtgatattc

SEQ ID NO: 264291 - DNA, 407 bp, Homo sapiens
atttagctagaatcaaagttgtcagcatttcctcaatttgcattgtttcaaagaggaaggctcaaatggatgtgagggagtatatccctatgccagttcactgcacccagtaattggcatcctgacttggccatttaggcacagccattctggcttctcatccctttgctgagcttctcactgcagatccctatcttttggttggaggttgggggtaagatcagacttttgacaagaccacaacaaaggaatcacaggtctatcactttggtcaccttagaagactagccaaagcatttcctaactctttgaggtcgcatagactgcctctgaagttgtatttctttcatagctgcagtagccacacattaattcacttgctataaataaatcattggatgcataat

SEQ ID NO: 264292 - DNA, 642 bp, Homo sapiens
cacgccaatgtatttagaccttgttcgacttgtctttgtttagctgacagctggccaagctggaggcagtacaagcagacagagtagggacagttgccctatcggcaaatcacgggaggcattaggaagaccagcggaactcccagcacaagctatcaaaccagccaagtcacaatctctgtttgtcattccggagggctctgcgcctcttagaagtcttgctcaataccctcctctcgaatatgacctcatatgacttttctgggcttatgcggggaaccattttcacattgtttgagttgaaccccacttgtatctcttttgagtgctagtaaatatttgacttaatggaagaaccccgctgagttaacaaaggtagaggcaaccaagtgcctccaaggcccagaagagagtcacagcctgatgaggaggcagtgagtgtggaagatggggcataaggcacagttggggtcagccatggcccttcctgagctagtccctgtctgtaagatggggatgaaagcatttacctctcaagggtgctgggggtcccaaacagtgcaggagtaacaacacaaggcactctgaacctgcccctgcagaaaatatataactttattgaggcctagtttaagacatatc

SEQ ID NO: 264293 - DNA, 406 bp, Homo sapiens
cacatatatacgtgtatatgtgtatatatacatatatacatatatacatatatatacatatacatatatatacacacacatatatatacacacatatatataatatatatattcttcctaatcagtcatcatatccaattggctctatcttctatatatatgtatacatatatacatataaaaattatatataccaaaatttatatatatataaatttcttctgtgttttgtatacattatgttacctgatgatattctgaattctccctatagaaaccaaatagaactaaaattttataaatctcccctataaaaaccataatttagagtatattgtttgataatttcttctacttttctattgttgttagtattttctcatttcttttcttaaattgcttttag

SEQ ID NO: 264294 - DNA, 601 bp, Homo sapiens
attataaggaaagaaagtcaccgctaattttacatctcagacagagccatagttaacgccttcatgtaatttcttctagcttttttccccatacatatacatgtggttttgtttcttacctcttttcttaacatagtatcaaaaatgttttcccttgtcattaaaatcttcataaatgtgatgtacatttttccatttgatgcatatttagtgagtgtcaggcatggtggatacatcagtgagcaaagtgcaaaacttcccatctcatgggctgccctcctgcaggtgaaatgacatactgggccattgggagctcacctagtaccctcaacccagcatccacccaggcccccggtctctcccaacctatggcttacttcctgttggtgaattcttcctttaagcgatcttgaaaataagcccttgcttattttcaaatgaataaatgtgaacccagaataaatgtgatttgtaaagttctcataactatcacatgtatatattctactatttgggttttttccacctagtttttgccattacaattaatgttcaaatgaacatctttgtacttcattgtgacattttgatctatggctca

SEQ ID NO: 264295 - DNA, 431 bp, Homo sapiens
gagaaggaagaaaaggtgtagagtggtggggaaaacttgataggtggctggaagaagcctttgaaatgctaatacagttacccacacagcaaacatgacctcctatgtgtacagaataaatatttaagggacagggaccattcccagaactgaaagtaggaaaacatgttggagtgtatctagccatgaatgcactgccctcaaatgcccaggcagcagtcttaagaggattccaccttgggggattcatggggctcatttttctatcgcaatctgtggtcagcattcagttagaaaagcagagccactaggagattttgataggcagatacatagataagcaggctgacagacagatagatggacagatggatagacttagtatacagatttgactttatgcaattgtgcgacctggtcaagcaggctct

SEQ ID NO: 264296 - DNA, 383 bp, Homo sapiens
ggtacttgcacataagctttaaatgtgtgttgtggtgatttattgctgactttgagcacatttatgtagcattgtggtaaaccacaaccttttcttccatttatgttttaatggaaagtagctttttttttctcctttcaaaacagtttaaccatttacttatttgatgtggtatatctcacttaagaatgagccatgtggagtgataattttgaaagctttgtaaaatgtttgaaatatccagtaaaaaaggaaaccaaattgtaccaattgtatgattatgactataaaacagctgtgtatttatatacttttacatgtttaaatgcacagatactttatttttgatgaagcatattaaacggaatactagttttacattg

SEQ ID NO: 264297 - DNA, 967 bp, Homo sapiens
  misc_feature (52)..(53): n is a, c, g, or t
  misc_feature (145)..(145): n is a, c, g, or t
ctgtatagatccctaaccagttgcatgtaacaagtcggtcggtgtatatctnntggaaatgaatttggtcatcagtgatagcactgcaatatgatgtaatggatacaattcacttatctcacaaaataagcttgctgtttctccnggggggccagggtggtggtatggatcagatctgacttggtccacgtcttctctctgctcaacaaagtgaaggaatcaagcctggtgtgatcaccacagtctgctgtatccagcacgttctctggtacacgctgggtgcccagtacatccttgcagatgagtgaatggcctgcctttccgtaatacaggctggcgaagcttccctgcgctcatgtctcagaagagatgctctctgctcccctgcaagtggaattgtctcccttgggagtagttgagaggtgacagaggctgctgtgagtggctagaccaaagtctccctgtgaagccacgtgatgactccaccgctccccagagctgcacatggtcgctcagaagccttggaggggttgggggaggcccctgctctcaagcccccactatcacaatcactttgtcccagctattcacctgcaaacttgcttgatctgcagaagctgcagagtggcccactcttcctggacatgtcaggaaaactttgacgtggctgctctagcttcagggaaggtctaatttggtgaaaatttgaaagcaggtttgtgggagtgccagggagaaatggggagagagaaagcctctgtatttgatggatggcaatggcttggagctggtgtgatggcctctctggatgacaaggacattggacttagagccagaaggactgaggtatgaatctcggcattcctggtttgtagttatggggacttggcagagacacttgaatgaaacttcctttgcccaggtataagacggaccccctaataaaggttgactgtgttctgatcct

SEQ ID NO: 264298 - DNA, 366 bp, Homo sapiens
ggaacttcacaacacctgggcacctggatggacctcaccccaggccaacagagaacccctggagtgggggcctgaatgctgaccatttctcaagagctagggtgatgcaaatgtgattgctttaacttagcacttctcaaacttgaaggacagtagggatctctggagatcttgttaaaatgcagggcctgattcagtgggtctggggtggagaccacatttctgcattctaacaaaactcaccaattactttgccaaatgaccattttgtctatgtaaccagatttcttgcttgatttggtaagcacaatatttagatttttaaagggaaattcatgcttgcttaagaaactttactagcagaaa

SEQ ID NO: 264299 - DNA, 441 bp, Homo sapiens
acaactttgcctaacctgaagtgacctaacaagcaaaaatctcagttgttcatcctccttcccacattttggtttggtttctagaacatacacagccttcccctaaagattttcagaacacctgcctttcagtcttcaccagagtaaaatctccacaagaggacaaaagcccacctaagaaactccttgtaggcacattaaactctaaccttgcaacaaacagaaggctacctgaatccctgcactgaactatattttatggtcatgctgtggctttccttaagggatgactacaggactgttgttatggatgcatgtgtctgactcttcgaagttgcctacctgaaatttctctaaagaaatttacattaaagataagtgcttgagaagctggtagttttattcctctaaaataataaaatgttccccacatcctgatta

SEQ ID NO: 264300 - DNA, 152 bp, Homo sapiens
tgtggtcattttcccatcttctccagaccaaacatttactcaataaagcattttccatttaacttctcagatgttattaagccaagaaccccttcttttcaaatggaatctcatataaaatcctgatatttaaacagatactactttagata

SEQ ID NO: 264301 - DNA, 488 bp, Homo sapiens
cacctaggctcctgctgcctgccctgatgtctgcagattcacttggtcaagaggagttccttctatgcctgctgtgtttttcagccatagcacagaactgttttatggggggagcatgctcatgcgctaaatcagtggtctctcactcagggaggaagagaggccaacatttgctgagggcttactgtgccctgggttctcagctgtccccacgagggggtgcaatgcccttggttttaaagagatgaaaatatcaaggctccaagaggtaaaaaacttgccccaggccacctagatgtggctggtgaagctatgtttgaacccaccgctgactaactccaaaattcatattcttttctcttgtctcggctgtcttccaagtatccagaatggactgtctggaaagcgttctgttagtacttcttgactgtgggactacaggtctttgagtttctcctaataaagtgatttctgatgaaaatctgaaa

SEQ ID NO: 264302 - DNA, 405 bp, Homo sapiens
aaattagctttaaagattagcttttaaaagccagttaagattcctaggtgcacaaacaagaactgtaaaattcacttgagaatgtgagatcagtaatgggggtgccacatgcaccaagaagtttgaaagtaagatgctgtgaattcggactccattaaacagactaaactcagtagtttatgatgaaaatattttctacttatttgtattttccttggtctgaaagattccagtaaagcaaaaaaggaattagagcttcattaaaaaatggctttattggccgggtgcggtggctcacgcctgtaatcccagcactttgggaggctgaggcgggtggatcacgaggtcaggagatcgagaccatcctggctaacatggtgaaatcttgtctctactaaaaatata

SEQ ID NO: 264303 - DNA, 1879 bp, Homo sapiens
gatgtacactaagcgaccctcagctgtgtgggaccagccctgccaacttccatcgtgggctcagctgcagctgccacctgcacacggtgcggggaagcagtgatggcaacctttcaccgtgcccacgccaccagcagcgtgaaacccagggccagacgtcaccaggagcctaattcaggcgattggcctggcagctacagggcgggaactcgctgctcagccatcggatttaggctgctgcacagtccccagcactggcgacctcgttctctgggcgcagggcaaggaagagaggaccccagttgggagggtggtgcactcggagacctgaaggccctctgggaccagccttgccagcctccgccttgggttcagctgcagctgtcatctgcatatggcgcgcggcagcagaggtggcaactctcaacgctgcccgagccaccagcagcgcggacccctggccagatgccccagcagcgcctaattcgggcggccggcccttcagctgcaggaggggggaaccagtggctcagccccatgtaggcggctgcacagtgcccagcactcaagacctcgcgctcaaaagagggcacaggaggagcagctgcagggggcagcgtcgttaggcgggccctgagacagctgggaccgcgcgctcggctctagggagctcggccagtccacaggcgtctcagcagcagctgccacctgcatgcggtgccggcgagtgctcggctcagggcggtttctggccacacgcagtttctggccacgcgcaaggcggttgccttttgaggtcccatgggcgctggggcccaactgctctgctccgtatattatttattctccgagaggttggagacgtccttgtccgagaagttggagggtccctgtctgaggtctgggccagactgccttgctttctggtgctgggccggatgggggccgggtgggggctgggctgggggaagggcgagggcgagttgtggcgtctctgaagccaatagctgggccatgaagatgatcttggctgtggagagccagaagggccaggtgcgcctgagctcctggagtagtaactgcatcttctctgacccctggtaccagactccagatgaggatgtcgggatgatacacaaagctgcgtccaggggaacgcgtgggagctgcagctgaggctcccgctgaagagaaaagaccagtctgaaatctacaagaacagagaattcttccaaatcaacatgaaaatacctctaaaactgggcaaagtactttttccagctctgcaagtcacctatgcacataggaaaaaaatacttaatgtgtccgataagagaaggactttaatttaaaaaaggaataaaatgccgttttctgtcctaagtttgtgaagatgaggagcagtgatatttacacttctgcttaaagttaagttgctgatgacttttcaaaaagacaatttggtggatggttccacatttggcctgtgccaatggctgcccagaagtggtaacttttctggtgcacagaaaatgccagcttaacatctgtgacagtgaaaacaagacacctctaacgaaggctataatgtgccaagaagatgtgaaactattctgctagaccttggtgctgatccaaatattaccgatgtctatggcaacactgctctccatatgctgtctataatgagaatatgtcaatggtagcaagactgttttcacacaagacaaacatcgaagtgaaaaacaatgtagagcaaccaatgttattttcaaaatatttgaaatccacttgttttaacattgacatatgtaagggtcagtttttgctatttggaagcttaagcaatccctgaataaaaataatttgaaataaaaaa

SEQ ID NO: 264304 - DNA, 407 bp, Homo sapiens
ataaaaatgaatttgtctcattgaaatataactagtttgtgaaacctgtggaatacttattttaatttcctacaatttacaatttatttcttgttctaatactgacaggctataatgtgccaagaagatgtgaaactattctgctagaccttggtgctgatccaaatattaccgatgtctatggcaacactgctctccatatgctgtctataatgagaatatgtcaatggtagcaagactgttttcacacaagacaaacatcgaagtgaaaaacaatgtagagcaaccaatgttattttcaaaatatttgaaatccacttgttttaacattgacatatgtaagggtcagtttttgctatttggaagcttaagcaatccctgaataaaaataatttgaaataaaaaac

SEQ ID NO: 264305 - DNA, 148 bp, Homo sapiens
cactcagcaaaagggtgaccttggacaatttacttagattctctatgcactggcactctcaactataaaaggggactaatagcacttaatttagtggattggcatcaagataaaatgagtgtagcctcattcctggattaaaaaaaaa

SEQ ID NO: 264306 - DNA, 1061 bp, Homo sapiens
ggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagaagttctaaaatagatgacaactacttgaaggaattgaatgaggacttaaagctaaggaagcaggaactgctagagatgctcaaacctctagaagataaaaacaacctcttatttcaaaagttaatgtctaacttggaggaaaaacaaaggagtcttcagatcatgagacagatcatggcagggaaggggtgtgaggaatcctcggtcatggagctccttaaggaagcagaggagatgaaacagaacttggaaaggaaaaacaagatgcttcggaaggaaatggagatgctatggaacaagacattcgaggcagaagaacttagtgatcaacaaaaagcaccacagacaaaaaacaaggcagacttgcaggatggaaagaggctctttcttccaccaggaaaagcaacagaggaaaatggaatgggtcaagtatcaggaacaaaataacatccttcagaatgattttcatggcaaagtgattgagctgagaattgaagccttgaagaactaccagaaggccaatgacctgaaattatcactgtatttgcagcagaattttgagccaatgcaagcatttttaaatcttcctgggtcccaagcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactcttttttctgaggtcattgccagatgaagcactgaagaattagcaggctttcgctccatttgctttggacagatttaaagactaggcacagccatttgtgttaattaaaatctctcgcacctttaaaaaag

SEQ ID NO: 264307 - DNA, 889 bp, Homo sapiens
ggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagtcttcagatcatgagacagatcatggcagggaaggggtgtgaggaatcctcggtcatggagctccttaaggaagcagaggagatgaaacagaacttggaaaggaaaaacaagatgcttcggaaggaaatggagatgctatggaacaagacattcgaggcagaagaacttagtgatcaacaaaaagcaccacagacaaaaaacaaggcagacttgcaggatggaaaggaaaagcaacagaggaaaatggaatgggtcaagtatcaggaacaaaataacatccttcagaatgattttcatggcaaagtgattgagctgagaattgaagccttgaagaactaccagaaggccaatgacctgaaattatcactgtatttgcagcagaattttgagccaatgcaagcatttttaaatcttcctgggtcccaagcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactcttttttctgaggtcattgccagatgaagcactgaagaattagcaggctttcgctccatttgctttggacagatttaaagactaggcacagccatttgtgttaattaaaatctctcgcacctttaaaaaag

SEQ ID NO: 264308 - DNA, 452 bp, Homo sapiens
ctctaaattcaactgaatttcccatcatatctgctggtgtttaaagaagaggtttatcttcagcaataatataacttgtgttaagacatttgattctgatagctttgcttttctctcctcccctcaatccccaccaactcttagcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactcttttttctgaggtcattgccagatgaagcactgaagaattagcaggctttcgctccatttgctttggacagatttaaagactaggcacagccatttgtgttaattaaaatctctcgcacctttaaaaaag

SEQ ID NO: 264309 - DNA, 1150 bp, Homo sapiens
ggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagaagttctaaaatagatgacaactacttgaaggaattgaatgaggacttaaagctaaggaagcaggaactgctagagatgctcaaacctctagaagataaaaacaacctcttatttcaaaagttaatgtctaacttggaggaaaaacaaaggagtcttcagatcatgagacagatcatggcagggaaggggtgtgaggaatcctcggtcatggagctccttaaggaagcagaggagatgaaacagaacttggaaaggaaaaacaagatgcttcggaaggaaatggagatgctatggaacaagacattcgaggcagaagaacttagtgatcaacaaaaagcaccacagacaaaaaacaaggcagacttgcaggatggaaagaggctctttcttccaccaggaaaagcaacagaggaaaatggaatgggtcaagtatcaggaacaaaataacatccttcagaatgattttcatggcaaagtgattgagctgagaattgaagccttgaagaactaccagaaggccaatgacctgaaattatcactgtatttgcagcagaattttgagccaatgcaagcatttttaaatcttcctgggtcccaaggaattagaattgtttaatcttattaatcttgctggaatagactctgctacttcaaagcagaaggccaaggagacagacatctgacaaagcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactcttttttctgaggtcattgccagatgaagcactgaagaattagcaggctttcgctccatttgctttggacagatttaaagactaggcacagccatttgtgttaattaaaatctctcgcacctttaaaaaag

SEQ ID NO: 264310 - DNA, 711 bp, Homo sapiens
ggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagaagttctaaaatagatgacaactacttgaaggaattgaatgaggacttaaagctaaggaagcaggaactgctagagatgctcaaacctctagaagataaaaacaacctcttatttcaaaagttaatgtctaacttggaggaaaaacaaaggagtcttcagatcatgagacagatcatggcagggaaggggtgtgaggaatcctcggtcatggagctccttaaggaagcagaggagatgaaacagaacttgcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactcttttttctgaggtcattgccagatgaagcactgaagaattagcaggctttcgctccatttgctttggacagatttaaagactaggcacagccatttgtgttaattaaaatctctcgcacctttaaaaaag

SEQ ID NO: 264311 - DNA, 361 bp, Homo sapiens
cattcctataaggtacactcaagggactgaatgaaaggaagggctcattacattctcaactccctttggtagtacacttttcatgccaggccctgagaagctgctgactggcaggaaccaaaaccttgacccatattggttttccacttccctctttaatttccactactttaaagctttgccaaaatgtctttccacagacattcgaggcagaagaacttagtgatcaacaaaaagcaccacagacaaaaaacaaggcagacttgcaggatggaaaggcaagtggactgcatgtacttaaaatttcaagattgtcgatgtcacacagctggaaacagcctgctgacaatcagggctaatt

SEQ ID NO: 264312 - DNA, 266 bp, Homo sapiens
tttccccctcaaaagaagctcttattttcctaatgtttccccttaggtactatgggcattacaactatggacagagtgactactggcagaaatgaacaccatgtggtgagaactactttctttaaacaaacaaaaaatcgttttaagggcttgaatagatagtgggtatagatttttggaatgcattgcttaacatatattctaatttaatattttaggggatttgcagagtgggtgctagggtactcaatattttagctgtcctt

SEQ ID NO: 264313 - DNA, 531 bp, Homo sapiens
atagaagtagaaggaatctttatcaatttatttgataaatacatgttgagtgtctgctgtgggccagcacttgggggattgtgaccacaatgtttaagcttttgtgctaactaaggagcagatggtggatatagcagacatgtattacagacttcagggggaaatcccaaatatttcagagaagaagaagatatagttctatagccggagactctgaaagagaagatgactaaagagatgagaagcccatctctacattcaaattagggctctttctaggtactcctaaagctcctcaaacagtcttggcacatagctgatacccagtaagttttacatatacatatataaaatatgtgtgtatatgtataaaatgaaagaatcaacaatgaaatcttgataatataatcatgattatgtttccaaattaccaaagataatgtacacattctgtcttacacatacacatgtactccaagtctaacagtccataactgtttgaatgattagaattagagatttgatagttct

SEQ ID NO: 264314 - DNA, 431 bp, Homo sapiens
aagactgctgggccaaatggtagctctaatttccttgagaaatcaccaaactgctttctacagtggccaaacagcaatattcacaatagcaaagaacatggaatcaaggtaaatgcccatcaatggcagactagataaagaaaatgtggtacatatacaccaaggaacactgcatagccataaaacaaatgagataatgtattttgcagcaacttggatgagctggaggccattagcctaagcaaactaatgcaggaacagaaaaccaaagactgcatgtgctcacttgtaaatgggagctaaatattgagtacatatggacacaaagaagggaacaatggataccagacctaattgagggtggagggtaggaggagggtgaggattgaaaaactacctattgggtactatgtttattaattgggtgatga

SEQ ID NO: 264315 - DNA, 494 bp, Homo sapiens
acttgggttgttagaataaggtcattcttgcagaatatggcacttaaattatctccagctgtaatgtcctaccatataatccagaggttgcatagaagcagagttgtcacagtctctgtagcacgtttgtgagaattctctaggcaggcccagcccttctctagaagtttgaatttcactcccaccttgttgctggggtaccttcttcagggtacatctaaacacagtggccttatacagaaatgttgttcaacccacacagtgctttaaaaaattaattgccaacatttaaaaatcagggagtttcacataaaattcagacttcttgtttccctttaaaaatgagaagctaataacatgagttgaattcccacaagtcaacaatgagctggaatctaatatggatggtcctcttatctttaccagtgcacatggtgaaaaaattcaaacagtataataaagtcttctttcaagtcaaaatatagagacgaatc

SEQ ID NO: 264316 - DNA, 516 bp, Homo sapiens
  misc_feature (6)..(6): n is a, c, g, or t
  misc_feature (11)..(11): n is a, c, g, or t
  misc_feature (20)..(20): n is a, c, g, or t
  misc_feature (500)..(500): n is a, c, g, or t
  misc_feature (502)..(502): n is a, c, g, or t
  misc_feature (511)..(511): n is a, c, g, or t
  misc_feature (514)..(514): n is a, c, g, or t
atggcntagancgttatgtngccttctgtaacccactccattatccaggggttatgtcccagagactctgcattaagctattagttagttcatatgtcatgggtttcctaaatgcctctataaacataagtttcactttctcattgaacttctgcaaatccaaaacaattaatcactttttctgtgatgaacctccaattattgccctaccatgctccaatattgacctcaacatcatgttattaacagtatttgtgggattaaatttgatgtgcactgtgatggtggtcatcatttcctgcatatatgtcctggttgccatcctgaggatatcttctgctgcagggaagaaaaaagtctctctacatgtgcctcccacctgacagcagtcaccattttctatggggttctctcttacatgtatctatgccatcgtattaatgagtctcaaaaacaagaaaaagtggcctctgtgttttatggcattattattcccatgntnaaccccttnatnta

SEQ ID NO: 264317 - DNA, 522 bp, Homo sapiens
atgaaaccatgagcattgctgtgagaggattttgagttttaggatgacacttatttctaggaggtgaaattacatttggctattcaaatatttgaaggcagcatttttacacccccacactaattttaaatgaacacttaaaaaaaatgaaataattattgctcccaagcattttgtatgacatgacttctcaaactgtccttatacttagctgggcttgcttttcagcatcctaaaatatgaaggtcagcattgaacctcaataatctgtgataattcataagtcaattcaaaaaataaaaatcaagatttttatttctgttgatattggcataaattctatccctctattaatacaagccatgatcttattattattattattactgttattaatattatgatcatctcttgaggaaaacaatctaagaaaaaataggatttgagactcaatatatatgattagaaataactagtgaataccttgaaggaagctataataaaattaaacatttttatgcc

SEQ ID NO: 264318 - DNA, 658 bp, Homo sapiens
tcatttattattttacagagcaggattatatttattatataaaataatcaaatgtataaaaaggaaaataaaataattcattattttcccagtgagctataaacctgtgttaacattttgatgaattggattatatttccttctctgttttctattacttttccccccatttttgctcaggaggtttgtgcgctttgatttggtttttgtttttgtttttgtttttgttttgtcaaaattgggatcatactgtatactacctcattaatgaacatttttttatatcatcaaataatctataaaatatagttttaaatatcagtgtaattgtggatgttcatgttcatttagttatttagtcattgcctaagtgatttaattaacttctgtggtaggggctcagcattgtgtggtggtgaagaacttggcatctggattagcaaaaggtctgagtttgtatgccagttctgtcatttctttacattttctttttataggtccagtgagttttctgtttgcttattataattatgttttttcctgtaaaattaaggggaaaaaatatattcctgtccactgatccaacagcccagggaatgtagggaaggaaccagagccacaggtagtctcagctagaaatctgcccctttgcccaaga

SEQ ID NO: 264319 - DNA, 451 bp, Homo sapiens
gcagacgaaggtttctgcaccggcatctctgctcagaagagatttgctgatgtaacaattatttgcactatttatattcaaatgttcttttaaaaaaatgcagcctctaaatttacggatagtaactgtgtgcaaatcaggaaacttatctcctttttatagtctaaaatcaaattacactttacatttttctcacttgcagaatattagattgtgatgcctaaatgacttgtgtttatgaaaaaggtgaattttaagaacaaattttaaaactgcataagcagtttaatgggtgtttttagaaagtgagaatgatcagctggtaagcatttattatatattaaactggaagttatatcgtcgcatccgttagcactgaattctgaaaatcatcatggcccaggtttgtgtttatgaaatgatggaccacaggactgttaaataaagttgt

SEQ ID NO: 264320 - DNA, 753 bp, Homo sapiens
tgagggtcttaaaaactgtccaaatattcttctgtcagtaattccagagtctagaagttaggactcccactggccctgtcatttctcaaatttgacctaaggactcagtgttttcggactggccagctagaacctttgtcgttcagcgtagccaagctcttattacccagtagtgtaccgccgtggttcaagattcttaagtgctgaattctccaaaaccttcatctctcatctcttgaaaccaggtggtataaccctgcttcagcatttctctctcactatcaaggtgatcaaactgtcgcttagagaaaacttcacctttgtcagtgtgtcctgaacttctctggcttctcatccccagaagtgaagcccacctagcaatctcagacattgttcatcacattgtccctatcagagatggcatcgcacaaaattcagagtttctgggaacatgttaaacctgtcacagcaatggttctggctacagcaggagtaaagaaatgtctaagcaagaaaaatgttttgaaagcctcaaaaaaagtttgtttgctgtcattaaaccagtggttctcaagcctagctggatggctgaagagcaggaagaagaggagaggttggtcttgctgtcttaggggtggcagaagcagaagataatccatgcataaatggacctgcacagtccaaagctgtgttcttcaagggtcaactgtatatttatttaaatttacataaagagatcatattctacataat

SEQ ID NO: 264321 - DNA, 459 bp, Homo sapiens
tgctaactcctttcctttccccgctgctcctcaccctgccctccctccctccctccacggttcctttctccatctgcctcactccctcccatctgtctccttgttccttccatctgtctgtcctctgtccgtcctcccctccctcctccctctatcctacttcctttctcctttttcttggctttccttcccgcctgtgtcacctctgccttgcacaccccgccccactcgctgctgccccggctctgccaccatctcttgggtccctgcctgcctggtgctcctcccttcctccattctgtcctgtccctgccctctcccgtgctctccatcttccctttcctttccctctgtcttttactctgtccatacccgcttcctgcctgactctctgcccccgtgtttcttgacatccatgtcactgcactccagcctgggcaacaaaacaaaactccatca

SEQ ID NO: 264322 - DNA, 476 bp, Homo sapiens
tgctaactcctttcctttccccgctgctcctcaccctgccctccctccctccctccacggttcctttctccatctgcctcactccctcccatctgtctccttgttccttccatctgtctgtcctctgtccgtcctcccctccctcctccctctatcctacttcctttctcctttttcttggctttccttcccgcctgtgtcacctctgccttgcacaccccgccccactcgctgctgccccggctctgccaccatctcttgggtccctgcctgcctggtgctcctcccttcctccattctgtcctgtccctgccctctcccgtgctctccatcttccctttcctttccctctgtcttttactctgtccatacccgcttcctgcctgactctctgcccccgtgtttcttgacatccatgtcactcccttcggccaacttcccattcccacgatgatctcgggatccttagagtagcc

SEQ ID NO: 264323 - DNA, 440 bp, Homo sapiens
aactccaaaatggactggcccccagtaatttacagtaggtagtcctaagccataaataaatagaatctgtgaatattagctttgttcatctgtaagaacttaagaaagtgctgggcattgggtcagttcaagtctattggatgaactgtgaatctcataatcatggaaatgtaggaataaagataaatatacataaaccaggccaggctcggtggctgactcctgtaatcccagcactttgggaagccaaggcaggaggatcacctgaggttgggaccagcctgaccaacatggagaaaccccatctctaccaaaaatacaaaattagccaggcatggtggcacatgcctgtaatcccagctactcggtaagctgaggctggagaatcgcttgaaccctggaggtggaggttgcgttgagccaagatcgtgccattgcac

SEQ ID NO: 264324 - DNA, 796 bp, Homo sapiens
aatgtatcagcaaggactgatttggcacagatgcaaaagccccagccagtgaacccagagctcacttcatggtgcataactggagtcctagacatgctcaacaacttcagagtggatagtgctctgagcacggaaatgattccttgctatataagcctttctgaggatgtgagatatgtgatatttggagatgaccatctcagtgctcccacggatccccagggagtggacagctttgctgtgtggggagcgcaacattcacctccggcaagcattactgggaggtggatgtgaccctctcctccaactggattctgggagtctgtcaagattccaggactgcagatgccaatttcgttattgattctgatgaaagattttttttaatttcctcaaagaggagcaatcactatagtctctccaccaactctccacctttaattcagtatgtgcaaaggcctctgggtcaaagttggggtgtttctggattatgataatggatctgtgagtttttttgatgtttctaaaggttctcttatctatggttttcctccttcctccttctcttcccctctgaggcctttcttttgctttggttgtacatgaaaagttggtttcacgatgatttattgtgacctcccacatatgaggcaaatactgtcctaagacactatgtgcgagagcctgtgagctcattgtaacttcatggaatgtaattactatgtggttatgaatgggataaccaccttgaatgtgtacttttgttaattaaattattttaattaataaaaaaaaa

SEQ ID NO: 264325 - DNA, 559 bp, Homo sapiens
ttcccttcaagttattgagccttctttaacgttatcacacacatacacacatacaaaggagcagcaccagtacatctactcaactgcaatgaaaaaataaaagtaaagatgccatcaaaacttgaataagtcaataaatcataacttagtctctttcttagatttacttagtaatgtccagtgaagaactctagttaaaaatacaaaaacaaaacccagcagttaatgagctactgattagaaaataagtgcataaacaataccagcgtagcagcaaaatacagttattgttaacattctgatgcacctcatttatcattttgtgcaagaaaaatgaccacagtctggccaattccagatttcaaactaaattcaaactcatacttaattgagcaaattatgcttatttgaaaataaatgaattaaattcacctcagagaaattatttgtatagacataaatcatgtagcaaataaagtacaaaataaatatcaatgacaaacatattggaatcaacttccctagctgaatttggagtgtgaggaaagatgatactgca

SEQ ID NO: 264326 - DNA, 355 bp, Homo sapiens
tagagatggggtcttgttctactgcccaggctggagtacagtagtgcaatcctagctcactgcagcctcaaactcctgggctcaagtgatcctcccatctcagcctctggaggagctgggactactacaggtgtgtgtcaccatgcctggctaattttttaaagtttttttgtagaggtgggatctcactatgttgcccaggctggtctcgaactcctaggctgaagtgatccttccacctgggcttcccaaagtgttgggatcacaggtgagaggtgccacgcctggcctatcaaactttttgatgtttgccagtctgacaggtggaaaacgctatgtccctgttgtattactt

SEQ ID NO: 264327 - DNA, 307 bp, Homo sapiens
ggaattcgaggtgggatgaggagataatctgtgtatggggcaaaagagatgcttccatcctcatctcctggcaacagccagattccatttttctccccattgtacaggaggggcacagaagttccgtaacttgccagaggtcacaaagatcacaatttgtagaggaagggtttgaccccaggcagccagcgaaggatgtatgtggggaacttgactaagtcattaaagcatatgagttttctacttcgtatactttaatcatttgaaaatgtattaaataaacataaaataccttaataataaaaaa

SEQ ID NO: 264328 - DNA, 547 bp, Homo sapiens
gacagacagacagacagacagacagacagacagatgacacaacaggcagggcatggtggctcatgcctgtaattctagctacttaggaggctgaagagggaggatcagttgagcccaggagttcaaggctacagggagccatgatcatgccactgcactccagcctggacgacagatcgagatctcatctctaaatatatacattttgaatgactattaatgaatatcacaatgcgtatgtgtatagcaactgtgctttacacagatctcatttaatcaccccagcagccccaggtagaggtgctgctgtttcattgatgaggagcccaaggctcagaggagttgaatcccttgcacaaggatgccaggctagtgactggcagaagcaggacttaggcctggcaatgggacttggtgtgtgctcagtggaggctcagagaggttgtgaaatttggccaaggtcacacagccagtctatgtgagaagaaagggattggacccttagctgtctgactccaatcacctgctgtgccctcagctttttctg

SEQ ID NO: 264329 - DNA, 446 bp, Homo sapiens
gatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaa

SEQ ID NO: 264330 - DNA, 422 bp, Homo sapiens
gtcctgtaaattaatctttgtgtagatattcctgaatttcaggaatatgtagactcaccccaaggtattctaaatttataagctcaccagatcttagatccagccacaacagaagtgaagattatactctcttaagtggagagttgaaggtatttactggaacatgactatataccagtaaaatgaaatagggggcaatgaaactctaaatttcaaccgggtagacggctaataaggctcatttgtatttaggaggttcttccttacctcgaaaaaataaaaaaaaaccctaataccttgaatctttactcttttaccctttcagtgtgtccatgttttatatatttgatatacacagatatatatttatatatgcaaatcctttccatattactattttataatttttcccagtgttccag

SEQ ID NO: 264331 - DNA, 396 bp, Homo sapiens
caatgatcctagctcttaattgaaaaaattctgcctcatcccaccactcacctgagtcttgagctctcactgttaataatgctgacagacagacagtcacccagctgggtttttggagtgagttcatgtttgtaagatgaggctcacaatatgtggttataaggaagcaacgccatcagcccatcccctcaaggcctataattttcacgtcaactataaagatagtacaagctctggttttgtgattttaagaaagggaaccaccaagggaaaattaaactttttgattcctagaaaatacattagaaacagctgtgctccaacttttccatgtgtaagcttatttccccaggtatattcagcccagtggattgtatggtgtctgttcttattaaa

SEQ ID NO: 264332 - DNA, 345 bp, Homo sapiens
gttagaatcatcctcatagatttaccactatgtctatatccctacacactgctgtatagttttgcttatcttttaactttctgaaaatgacattttactgtctgctttcttatacttcatgtttgtgtcacttagcatatgtttctcgaattcatccatgctgtgtgggtttctggatctttgcagaaacagagctgccataaacattcttgtcgggtctcctggtttccatgcacaggagtttctctagggtatacaccaagaagtgaaaatgctgggcagagcaggctatgcaatttgtaaattaaaattaaattaattgcattaaaatttaattaaatttta

SEQ ID NO: 264333 - DNA, 440 bp, Homo sapiens
aatcattgccatggtcagcatgtatagagattgtttcacctaaaaggagtctcctagtttggatcaaggagttgacaacagcatattctaaaataaaattcgaacttcctagcaaagctaattaaactgctgaaatgtgttagagtttatttactataacaatgtttatgaattcaagatggtctagaaatggatatcattgactaaaagagagatgattcgatttaagtattttcaagtaattatattataaaaaacaatatattcattattctaatcttatcataccttattttattctgtatttgttgatcagattctagtggagttcagagtcattgaaatgaaggccaatttttgttgtaaaatattatgtcttgtaaatttagaaagtgttcagatggggctaaataaaatttgatggttcaagcaacccagga

SEQ ID NO: 264334 - DNA, 320 bp, Homo sapiens
tctgcagaggttacactttatagcctataaaatgttttcacaaactgtatttcatttagttgtcagcacactgctgtcaggtacctaagattattcccatttcacagatgaagcaactaaggctcagagagtcctggatgagtccagtatgttggaggattctagacagccatctgaattccaatactcatgcttttggaatatggacattttaatagccaagactgagtcagcatcttctctttctttggaagtctctcttccagattccgtctggtaaatttccacttgtacttcaactcctagcttcgaagtcatca

SEQ ID NO: 264335 - DNA, 544 bp, Homo sapiens
cacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgc

SEQ ID NO: 264336 - DNA, 262 bp, Homo sapiens
atttacaaactttgtgacctcggcaaatccagtctagctgagcctctggttcctcatagataagatcgtgaaaatgagacagtctatctccaagggcagtttggaggataaaggagacagcgcatttctttgtggtaacatttaaaatctactcttttagcaattttgatacgtgtatcataatatcacattgtattccataaatatatacaattattatttgtccatcaaaaatagaatgaaaacatttaaaaataatata

SEQ ID NO: 264337 - DNA, 517 bp, Homo sapiens
catggggaaattttgtactagttttttaataattataagtcttacatgttctctaattcttcttgaatctgtttaatttttctcccttgggaattgttaagtgtacatgtattgtgataactgctataattttgcttttattgattttttttgctttatatctgctacaatttggttcctccaaatcccatgttgaaatctgatccccagtgttgctgggggatctaatagcaggtgtttgggtcatgggaacaggtccctcatgaatgaattaatgccctcactgggaggaggggataagtaagctctcactcatttagttcccaagacagctggttgtttaaaagagcctagtgccacttctctcttgcttcctttcttgccgtgtgatctctgcacatgccagctcccctttgccttctaccatgagtggaagcagcctgaggctttcacctcatgcccagtcttccagccaccagaattgtaagccaaataaacattttttctttataaatta

SEQ ID NO: 264338 - DNA, 386 bp, Homo sapiens
gcaccagcaaaattagttttcttagtactagaaagatttaaaaagaagcagtgctaggtcaatgccccatgcaaggccatttaaagttggttctgtatctgctatgagaatctgactagtctaacattgctggtttgtagagttgctaaagaaacaggaggctagcctgggtctgtattatgtattaaatgatgttatgttaccaggtgcccttgatgatttcacaatgtggaggaaatgtattctttaatagagctttgtttctatacaaagcactttgtagtagtagcagtaggaatagaaaagtgggtgtagataggaagtcaaattactggactgagggaccataatgattgggggctacggaaagaaacaaaaaggacagg

SEQ ID NO: 264339 - DNA, 754 bp, Homo sapiens
taatgataatatgaatatttgttgagttatagcaatgtataccacatcacctcgtcacccctcctcagcaggagcatcagctccttcaggaagcttttcctgattatttgtgcctgcttcagacacattagatgaccccataaatctctggacatatctgcaccacttctcttgccagcttgtatgttaattattaatagctgtttgggtgtctgtcccccacagggaatcatcaaccaccgcaatagagaaatacataggattctgtggaacacagctgggagaacaggcaaatttgctcaaagagttccaaaaagctatagaaaagaagtgaccttttaatctggatctaaagagatgagtagagatttgttttaggaaggaaggagtaaagggcattttcaagtagatcaaaggcatggtgtgtttgtcaggccataatgcttatggggtcctcccacatccaggcactttgctagtgctaagagtagacagaaggtagatttggctggaaggtggagtgtgtggggcaggaggtaatgggggtgagaatggggaggtgagttattaccacaggtaaagaaccttgtggaactagctaaggagacagctctttttttcctggaggccaagggaggcttctgaaggattttaaggagataagtgtcagagtcctatttaattctaaatgagaaagatctctatgaacaggtatggtgtgattcataggatgtattgattggtgaaaaaacaa

SEQ ID NO: 264340 - DNA, 402 bp, Homo sapiens
cctctgcattaagaacacagacatggggagagcaaagaggcttgaggctacacaatcttcaacccatcagggttctctcccaagggaaagcctagacctggccgtccatgcctccgatccagacagagcatcccagatagggcccaggttccttaaaagcaaaagcaaagctgggtcacctggagaccttgtctgggaggaggcagaagaaaccacaggtagagataggcaccgaaggccacatcagcacattccttaacctcagaggttctgaaccaatgggccatttgcaaagtctggaaggagacgttttcagttgccacaactgaggagctgctgccggttatgcagcaggtagaggccaggaatgctgctgacatcctatgctgcctgcacagggca

SEQ ID NO: 264341 - DNA, 316 bp, Homo sapiens
cgctgcttgacccctggggaggggggcaactagaatgatggagggggagagcatttggcaggatatagggaggcaccaagccgaggccccactgcagagtgttaaattacgtcttcagcgtgcagctccagttacacatgaaatcagattaaatatctggagaatcaagacttcgactcaaataccttcaagtggatggtgaaaaaaatcagtagcctcattttttaaactacattttaaaaccaccaacagtttagagttacagatccatggcaattttaacaacttttccctcctttttggaattttctaagta

SEQ ID NO: 264342 - DNA, 645 bp, Homo sapiens
gttgaactaactgtggcttgcaacaatcaaaccactctttcatatatacttaaaggaaaaaatggcattatttgggacagactggaagactgtggaggctggaaggagaagggggtgaaaattacattcttggccacgttttccacacaacccattcctgaacccctttccacagacaatttggaaatgtgcattcaataaaacccctgtcgcaattgcagagaagcagagggtagaagagatcgggcttggagtcagcatctgggaaaccttgtataattttggccttgccataaaccagcagaatgacctcgggcaagtttacttttccgattattagtgtccttatctgtaaattggtatcaatcattctatcttgcaggattacctgagtggttagtgataaatatacaaagaacctagcgtaatagctggcacatagtaggtgctcataaaaaataattattgctgtattgctacctttataactagtgttgacagcttctggattcgacctggtgaggaaaggggataaatatagaagacgtttatgaatttgttttttaatctattttactctttaattatttaatatttaactggttaattattcatagtcaaacagaaggcttaataaaaatgtgc

SEQ ID NO: 264343 - DNA, 397 bp, Homo sapiens
tgcccccttccttgaattcctcaattcatttggctctatcatctgtagttttcctacccatcaccatcagatcctcttaaaaaaaaagtttcaatttctactaacagtttctgaacacctggatctctgctgggccctgtgttaaatcattgaatgggaagcagctaatccatataaataactccggctttggagtcagtaggatttaggttgggatcacagaccagatgaactatgaaatcttgggcaggttcctgtggctgtcttggctttggcttcttaaatggagagaattatatttgtctcacaagatgataagaggaataaatgaatctttcttaatcctaacattaattttacttccaaaaataaaaatcctatgaatacatttttaaaa

SEQ ID NO: 264344 - DNA, 295 bp, Homo sapiens
tgatactctctgaagaaggtttggcattgcaatatattccactggttatttaaaatagatctgtgcgatctgaaaatcaaactgggtgttaacgcggtggattcctaaatgaaagtttactttaaaagatgtaagttcaggtgttcacgcaggcacctatttctctcagaagaggacttttgacaaatgattgacccaaggacaaaagaacaagagtggtgtgacaaatcattccaacagaaaaactttgctaaggatagctaatgaaaagtaagccaaaaattagttctactct

SEQ ID NO: 264345 - DNA, 414 bp, Homo sapiens
tattacaaataatccctacattataggaattatttgggtttctgaaaaggtggctgggcagaaaagatgaacaatctcttcctttgagtctatttgctagtttaaatttagtggcaaaagcaagttgcatcatagttgctcccgtaataactagtgacatgggctctacaccctgcctggcacaggctgtctttgctgtgtgctataaagcccttaccaggcccaatacagtgagaggcacacagtgggtgctcaagaaatgcttgttgaggctgtcaaccatgggccgtgcaggcagtttaaagcacagtaggcatctggatctttaaaggaaattgtaccgttctaagagtcattaaatgagttcttcagggagggcagtaacaatatgccacctgattgctttgttcagaa

SEQ ID NO: 264346 - DNA, 311 bp, Homo sapiens
actaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtg

SEQ ID NO: 264347 - DNA, 685 bp, Homo sapiens
aatggcccaatcaaaagtagacctctattctttgtttttctgagataggaacaagccagaaatttagttattcaggggtggggtgggaaagctgtgggacccaggggtggaaggacccacacagttcaaaataaaccgaaccaactatagtgaaggaaaagagaactatacgcagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgaaaaatataatgaatgaaatgaaaaagtcaacagagagtatcaacagcagaattaatcaaacagaggaatcagtgagctcaaagattatatgaaaatatacagtcagaggagaaaaaag

SEQ ID NO: 264348 - DNA, 412 bp, Homo sapiens
cagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgactt

SEQ ID NO: 264349 - DNA, 727 bp, Homo sapiens
gttcataaaagatacacaaaaagtatgcaagatcaggaattttaaaaactaaggtaaatagatggctgtgattgcaggacttctgattgactgcctgagctctgccatgttcacagatgtggatgtttgaattatctatgtatttggccaaggttcattatattttctaagtctgaaaactgatgtctttcaaatactcaactagtgaattcctctccttctggaactctaattaaatgtgtgttggacctatcactctatcctccataactctcaccatgcttttcaatgttctgcatttcttaggctcatgcatttttggagtgattgctctgagccggacactgttcaaggcacttggaaaacatccacaaacaaacaaataaaaatcccagccttggtagaagttacattcccgcagaaggcaataggcaactgaaaaaaagcaggccaggtgcggtggctcacgcctgtaatctcagcactttgggaggctgaggcgggtggagcatgaggtcaggagatcgacaccatcctggccaacatggtgaaaccctgtatctactaaaatacaaaaaactagccaggcgtgttggtgcacgtttgtagtcccagctactcgggaggctgaggcagaggaatcacttaaacctgggaggcagagattgcagtgagctgagatcacaccactgcactccaggctggcgacaaagcgagactccattaa

SEQ ID NO: 264350 - DNA, 736 bp, Homo sapiens
caagtcaccgactttttattacccgtccactgatcagaaggcgtgatctagatggacttcagtaggcagcaattcagtccaacaaataaggatctattactgagcatcaactatggtgaaactgtgcttggtggaagttcaagaatgaatatatcaaaagtcacgtcctgcaggaagtcacaaccaacaacggagataaactgttaaactgaaaatgatccttgtatgaatcaaagatgctggtacacttgattttcattgtcttttttatggaactccttctcaaatgttcagatctacttaatcttgacaatttatctctttgctggctgaggtaaaaagagcaacaggcagtataggtcgtcaggagaccctgaaaagggatgagtgtgtgtgtttgtatgtgtgtgtgtgtctgtgtgtgtctgtgtgtgtctgtgtgtgcgtgattataaatagtacacactgtagaagcctccacattcagtccacactgccctcttctcaaccttaacgccaactgctcacaagtccatgcgctgcaaattctccatgaatctccaggttctcattagaaagtgcactttcaaactgctttatctttactcataacagtttcctcttctggaatgtctccctcctccaaatgcccattacactttaattatgtttcacatagtcagtgctcaataaatatctgtggaaataagtgaagtctcctatccttatatgtaat

SEQ ID NO: 264351 - DNA, 977 bp, Homo sapiens
caggagacagacatgatcataggaaacttcctcagatcttccaagactaggtttgctttgtccctgaatatgcttccagagtaccctctgctgaccctgagtactgtctatagcaccaaatggaagactgtctgtcgatacacattttgtgacaggctcagttttgtataactattgtcaatctccataaccctagcacataggaagtctctggcacatatcagatgctcaatatcggttgagtgaatgtattaatcatctcctttaaaaccagagtcagtggattgaagggatggacttcagtaggcagcaattcagtccaacaaataaggatctattactgagcatcaactatggtgaaactgtgcttggtggaagttcaagaatgaatatatcaaaagtcacgtcctgcaggaagtcacaaccaacaacggagataaactgttaaactgaaaatgatccttgtatgaatcaaagatgctggtacacttgattttcattgtcttttttatggaactccttctcaaatgttcagatctacttaatcttgacaatttatctctttgctggctgaggtaaaaagagcaacaggcagtataggtcgtcaggagaccctgaaaagggatgagtgtgtgtgtttgtatgtgtgtgtgtgtctgtgtgtgtctgtgtgtgtctgtgtgtgcgtgattataaatagtacacactgtagaagcctccacattcagtccacactgccctcttctcaaccttaacgccaactgctcacaagtccatgcgctgcaaattctccatgaatctccaggttctcattagaaagtgcactttcaaactgctttatctttactcataacagtttcctcttctggaatgtctccctcctccaaatgcccattacactttaattatgtttcacatagtcagtgctcaataaatatctgtggaaataagtgaagtctcctatccttatatgtaat

SEQ ID NO: 264352 - DNA, 525 bp, Homo sapiens
caggagacagacatgatcataggaaacttcctcagatcttccaagactaggtttgctttgtccctgaatatgcttccagagtaccctctgctgaccctgagtactgtctatagcaccaaatggaagactgtctgtcgatacacattttgtgacaggctcagttttgtataactattgtcaatctccataaccctagcacataggaagtctctggcacatatcagatgctcaatatcggttgagtgaatgtattaatcatctcctttaaaaccagagtcagtggattgaagggatggacttcagtaggcagcaattcagtccaacaaataaggatctattactgagcatcaactatggtgaaactgtgcttggtggaagttcaagaatgaatatatcaaaagtcacgtcctgcaggaagtcacaaccaacaacggagataaactgttaaactgaaaatgatccttgtatgaatcaaagagcggccgtccccacccgcgccgacaatacaatcatcaaaccaacaca

SEQ ID NO: 264353 - DNA, 621 bp, Homo sapiens
ggaggcactggggactcagaggctggactgggatctgtgagctcccacaggctggaccggggccatctaggagcccacatctcctgcaaagccacataacttatccatgccccctgtaaacagtgctcacaacacagggccttaaaggaggtagctctagggtacacacggaatccctccgctgggggctggccagtggtagcacccagctggaggtgctttgctgccacctcctgagggtgttgctgggaggatttgaaatcagctgcacggtgcctggtgcattccagcttttagcgaatgggtgccatggctggttattgttattatttatattttgagtccaggtcttgttctgtcgcctggattggagtgcagtgttgtaattgcagtcacagctcactgcagtctcccagctcctgggctcaacccatcctctcgcctcagcctccagagactataggcgagagccaccttgcccggcctgttgtcattatttatcattatattgtttttttttgagacggagtctcactctgttgcccaggtggaggttgcagtgagccaaggttgcgccactgtactccagcctgggtgaggagagcgagactctttctgaaa

SEQ ID NO: 264354 - DNA, 408 bp, Homo sapiens
aagtgaactgtagcctaaaaaaacatgaaacctagaaaagagttggtgaaattgaggtaaaaggacacaaagccaacactaatgagaacctcttaacaacaaggaatcagacacacaaataaaaagtccaacattctgggtaggatctgagagcagatgcccaaatttgggttaaatatcatagttatttctcataggagaggcaccatcaacaagcagtatgggctgggtgcagtggctcactgcatccagtgagcctgtcatcccagcactttgggaggccatggtgggaaaatggcttgagcccaggagttcaagaccagccagggcaacatagcaagacccccgtctctgcaaaaaaattttaataattagctgagtgtggcagctcatgcctgtaatcccagg

SEQ ID NO: 264355 - DNA, 452 bp, Homo sapiens
gcatcacagaccaagcccattattgaggactgtacgtatggagcaggcccgtgagcttgtgactgagtttcccaacctgccaggctcccatttgcttaggatgaatatttttctgccctccctggtgagccactgtgggccactcgccactccttacaccccttccctttaatacctcgcttggcttacttgcaaaatccacatgcatcctcctggatctcacagaagatgtatgaaaagtcatggccatgaaaagggcacggaaatcaaattaattaattttgctttttccccacgtttgtttctgtctgtctggtacttttcctttttaagcctgccatctctttgaaagtgagccgcacagtgataatccattttcttcattgtaaccccacagtgtatgtattccacattaaataataaaagggattaataattaaatcaaaatgaaa

SEQ ID NO: 264356 - DNA, 317 bp, Homo sapiens
agggcagccactttggaaaagcttgtcagttcatcaaaagattaaacataggctgggcacggtggctcatgcctgcaatcccagcactttgggaggccgagatgggcagattgcttgagcccaggatttcaagaccagcctgggcaacatggcaaaaccccgtctctaaaaaaaatacaaaaattagccgggcatggggccacgtgcctgtggtctcagctatttgggacactgaggtcggagaatcatctgagcccaggaaattgaggctgcaatgagccgcgattgcgccactgcactccaagcctgagcaacag

SEQ ID NO: 264357 - DNA, 1194 bp, Homo sapiens
gatggttttttcctatttctgaaaaaagagttattaggattttgacagggatcaaaattgaatttgtaaatcaagggtagttactgtcatcttaacaatgttaagtcttccagtctgtgaacatggaatgtctttccatttattttggtcttcttttatttctttcagcaatgttttgtacaggtcttttagtgtacaagtcttgtgcttccttggttaaatttttctcaagtatcaatcagtataatctaccacattagtagaatgaagaaaaaaaagaactcactacagtctgtcctttgtatctatgagttccacatctgcagatcaaaaatatttggaaaaaaaaataaaaggtaatacaaatttattccttaatcaaggaccagaggaaaaaaaatacaacatttaaaaatagagtataacaactgtttgcatagtatttgcattgtattaggtgttataagtaatctagagatgatttaaattgtataggaggatgtgtgtaggttatatgcaaatactatatataagggacttgagcattcaaggatttggtatctttggggggtccagggtccagtcccccacagatactgaggaatgactaaatcatctcagttgatgcagagaaagtattaaagaaaagctaacatcctttcctttgtaaaagcactttaataaactaggaaaagaggggaatttcctcaacatgataaaggctacccatgaaaaatcattgcttacatcatattcagtggtgaaagactgagagattttatcctcagatgaggaacaagatgaggatgccttctttcaccatgtctattcagtgtagtattagaagttctagccagaagttaagcaagaaaaaggaaataaaaagcattcaaattggacaggaagaagtaaaactatctctatttaaaggtgacatgatcttatacgtagaatacccttaaagttatgccaaaaacaaaactgtgcaagttagtaagaaattcagcaaagttgcaggatatggcatcaacacacaaaaatcagttgtatttatgtacactagaacaatcccaaaaggaaattttaagaaaacaatttcatttacattagagtcaagaagaaaaaaaaaatactgaaacacctgtatccctttgacttaactccaatagtccttgaaagattcctccccgtccg

SEQ ID NO: 264358 - DNA, 1044 bp, Homo sapiens
cttgggctgatgagatgagatgaatgtattttgtatgtagtaaagatatgaattttgggaagccaatggtaaaatgctacagatggaattttgtcctcctaatactcatatgttggaacctaatatgactctatctggagacagtgatagtaggagatagttaagattaaatgagccaggccaagcgtggtggctcacgcctgtaatcccagcactttgggaggccaagacgggtggatcacctgaggtcaggagtttgagaccagcctggccaacatggcgaaaccgcatctctactaagaatacaaaaattagctggggtggtggcatgcagctataatcccagctacttggaaggctgaggcagaagaatcacttgaaccaggaggctgaggttgcagtgagccgagatcatgccactgcactctggcctgggtgtcagagcaagactccgtctcaaaaaaaaaaaaaaaagattaaatgaatcataagaatggggccttaatctgatagaattgtggccttttaagaagaggaagaaagagaaaaagagaaacatctgtctctttctctctcttaaccgtgtgaggacgcagggagaacgtggccatctgcaaatcaaggagagagtcctcatcagacattgaccctgctgtcaccttgatcttggacttccagtgcccagaactgtgagaaaagaagtgtctgttgtttcagccactcagttgatggtgttttattatggcagcataaacagactactgtaggagcttagactctgggtcctgatacatatcggatcctgatgcttatcaaatccaggctccttccttgaatgtgtgacctttggccaggttctcgacttctctatgcctcagtttactcctcagtaaaatggagataataatattacttatcacctcagtaaaatggagacaataatattacttaccatctaggtttattttgagacttaaataacttaatgtatgtaaagtatttatattgtgagtgcaaaataaattaactattataataaaaaaa

SEQ ID NO: 264359 - DNA, 508 bp, Homo sapiens
agagtccacctcagtgtggagtcacatattattacttctgccgcatcctgttgacccagcctaaattcgtggtgagagaaatagattccacctgttaatgggagagtgtcccgggatgggggcactatagtggccttctgaaaatctgttttggccctcctcaaggtgatattggattactgcttctcgggggtctggttgggggagagggtgggttttaacctcaaatccttttcataatcatacagaaaaaaagagtagtatgtttttggggagaaaccttgggagctgtccaaacagaaattgaaatcacagcatccacactgcctgatctaatgcccagctagaccatgcaaacctgattccgaccgaatgcccagccagaccatgtaaatctgattctgagctgtgcacaaggctcacacctgtaatcccagcactggaggttgcagtgagccaagatcatgccactgcactccagcctgggcaacagcaagactgtctcaaa

SEQ ID NO: 264360 - DNA, 591 bp, Homo sapiens
cttctttccatcctcttaacagacctgacaagatcagcttcccctcctaaaccatgaactctctcaaggacctggactgtgccttgttgtctgttcaactgtgacctcactctagatggtagagcccaatgcccagcatgcaattaacaggagctgcctgcagacacaaggctggctctgtgtcccctcccagctgagacactgagccccagcactaggcacgtggatgggttgggcacatgacctccctccctttctgagcaccttgcccattccaagagctcacggaatcagactccgcgactgccctgagttctgacttctctccccatctccctgcactttgattctcttgaccatgggtcctcctcactgcatatcccctgcctgcttgagaaaagggatgcagcccagatggtcaataaccccctgaggtcctcctcctaggaatgtctgtatttgctcacaaagagaagtttatatatataaaaccaagaaacaaatttctaatggtattaattgaattttaggcaggccttgaatgatggggtggggtgctctgatctgagtcggtgcgctcacgacgacgag

SEQ ID NO: 264361 - DNA, 728 bp, Homo sapiens
agcggaggtgaagaggagaacgatgtccaggcaggggccggggaagctcgtgccaaggcactgaggggaagtgctgcaatgaacctcagaggctggatcttgctgactcatctggggtaccaaggacagacaaaggacatggagtccaggcccaggaggcgataccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaagagacgggtctcactatgttgcccaggctggtctcaagttcctggattcaatgttcttgccttggcttctcaaagtaccaggattataggcatgagccactgtgccaggcccaaacctagcttctgagtggaaaaatttctgctgccccaccagcttcaggaagtgggagtcaactctagtcactgtggtgatgcagagattatacggctgataaaaccccttatttttctctcc

SEQ ID NO: 264362 - DNA, 653 bp, Homo sapiens
agcggaggtgaagaggagaacgatgtccaggcaggggccggggaagctcgtgccaaggcactgaggggaagtgctgcaatgaacctcagaggctggatcttgctgactcatctggggtaccaaggacagacaaaggacatggagtccaggcccaggaggcgataccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaaggtgagcacccgcctccatcctagagaggattctgtgagaatcattgagagggagctactctctccaggcaatcacgggggtgagaaagaaaaaaaaaaagagagggagttactcatgtactgacttattcaatgaatgcttatgttgtaatacctacta

SEQ ID NO: 264363 - DNA, 680 bp, Homo sapiens
agcggaggtgaagaggagaacgatgtccaggcaggggccggggaagctcgtgccaaggcactgaggggaagtgctgcaatgaacctcagaggctggatcttgctgactcatctggggtaccaaggacagacaaaggacatggagtccaggcccaggaggcgataccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaaggcaccaggggcacgaacagtgttgcccgcatggaactcacacttaatgggagcggcagccaacaggatgatacccggcaaattcttcaaagcagtgttctccaacttgaatgtttgtgatgtgggcgattctgactgagggggtctgtagaccacatcttgataaacaatgctttttaaaaaattc

SEQ ID NO: 264364 - DNA, 284 bp, Homo sapiens
ttgagtggattaatttattaattcaactggtatttactaaataaaatccatgtatctttcacaatttttactaatactttctatcactatcagaatctgaaatctcagatttcatgctttaaaaagaattaatttaacatgaattataaattataattacttatatgaattggataactaaataaaataacaagatatttaaggggagaaaatcttatatgtggcaagataagtggtgctccattcagtgtattaattgcaaccaataaattggttaactgtgt

SEQ ID NO: 264365 - DNA, 1462 bp, Homo sapiens
ccgggaagcggtttgggaagctcgggggtcggctcggaaagtagagggggcgcagctggggcgggaggacagcgtttgtgcccggaagcgggagaggaagcgggaagtttgtgggatccccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggctgaggctttacagttctctatactctcccaagagccacagaaaatgaacacatttcaggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctc

SEQ ID NO: 264366 - DNA, 1806 bp, Homo sapiens
ccgggaagcggtttgggaagctcgggggtcggctcggaaagtagagggggcgcagctggggcgggaggacagcgtttgtgcccggaagcgggagaggaagcgggaagtttgtgggatccccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggatgccatactgctgttaacatatgtgacactggagactttgtccctacctcatagaatcccatgcatgatgatacatgaagggttttccgtggctatctacttctgattcttttgaaagctttaaagacattgggcatgaaaggttcagtgagtttccggggatccctcgtttgtggtagagccaggaggaaaacagttccgttcattctttcacagctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctc

SEQ ID NO: 264367 - DNA, 427 bp, Homo sapiens
gcatcagtgtcattccaggacgtgactgtggaattcagccaggaggagtggcagcacatgggccctgttgagaggaccctgtacagagatgtgatgctggagaactacagccacctcgtctcagtgggtgagcacagcttaccatggggttccctccagagtgcagttctgtttctcctctctttctctctctccataccgtaccatgtgactccctctacagtgcaattctggttttccttttttatattagtcacttttattgaggtatacttaacagaaaataaaattcagcacctttcagtgtacaaatcaatgagttttgaaaaatgtatacattgattaccacaatccaaatcatggtttggaatatttttatcaccccccagaagattctttgtagccctttgcagtgagtcccctccct

SEQ ID NO: 264368 - DNA, 163 bp, Homo sapiens
catgagggcggacgttttgcctcattctctttggaacagtggacacacagggacttacacaaatatctgttgaatgaatgaatgtacgcttcacatttgatgacttactaatgtaatgatgtctgaccaatagataaatctttttccgtattaactgattgga

SEQ ID NO: 264369 - DNA, 309 bp, Homo sapiens
gcttattattattattattattacctcaattcatggcttctttgtagaaatcagcttaagctacttgctcattttgggagaggtaatttagttaaaatttaacaatataatttgaaaataatctaatatatattgtaaaatgctgaaggtcctactgtcaactctctgtttgtggaagctttctctgcccttaggttaccttgtaaacagagtataaggagtgacctgcttggcatatcaataaatgagactgccatcgttaaaaattagtaaagctttcctgccagcagaggtgtgctaaaaagaaaa

SEQ ID NO: 264370 - DNA, 404 bp, Homo sapiens
ctgggctttttttggttggtaagctattgattattgcctcaatttcagagcctgttatttgtctattcagagattcaaattcttcctggtttagtcttgggagggtgtatgtgtcgaggaatttatccatttcttctagattttctagtttatctgcataaaggtgtttatagtattctctgatggtagtttgtattttttaattttcttttgtacttgagatgaaccatatttgcattctaaccccaacctttaatacaaccaggatgtttttactttcccttttttgtgtaagtaaaaagcaaacattggtgaggaaggtagaagatgtgtgtcccctcctctttaatttttttttttttttgcgacagagtctcgctctatcacccaggctggagtgcagt

SEQ ID NO: 264371 - DNA, 1544 bp, Homo sapiens
  misc_feature (110)..(110): n is a, c, g, or t
cctcttcctgggcggcgatctctgggacagatgcgcagaagacttcctgctcaacgacgacgtcctccctgagagcgcccaggaaaacgtccacttccagcccagcagangagtcgtcctgcgctcctgagcgttcgtcgacagagctcaggaggacctctgggatcaggatgagggtgtgtccatcgagagacactcgcaggatcgacgttggcgggagctccagcaccaggtcgacgtcgtccaggggcacacgcagggcacagcccgcggccaggaccactatggagcactttgagtatatcatcccactgtctcctggagggcaagattcagccttaagggggttcccttgtatgtgagtgctgcaagaactgggtgtgactcggaatccctcccaaccacttccggcgcaagtggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttacc

SEQ ID NO: 264372 - DNA, 323 bp, Homo sapiens
taaaggagcctccttaaggagcacttgtaggaccagagagagtcagagttaatagcaatgatagtaacttcaatactttatgtggagcagctgtgtacaatgagctagggctgggaccaagcattttatattcatcatcttgtttaatctgtgttgttaccttgtgaagaaggtaggattatctcgatttcacagaagaggaaactagagatgagattccctgtccaagtttacactgcaagtaccagatggaccaagcttccaaccctcctctctctgactttaaaccttatgcattccattaaaattaaaggaaaaagagt

SEQ ID NO: 264373 - DNA, 267 bp, Homo sapiens
tcccctgcattacctctactgtatatgtaatcacttcctattaacgtattaatctcctccaataaaaactgcagcctcttaaggtcttggactgctctatttcatgattggttagtagagcatttctttcctataatccacactggccctctctgtgaagaatgccctgtatgcaataatctgactgatatcacagctttacattattctcagccccctacaaatcttaattcagccattttttttcctttttttttttttttgaga

SEQ ID NO: 264374 - DNA, 640 bp, Homo sapiens
gcgggagaacacagaacacgcaccctttcttttagtcaccctggaggcctcggagaaggcggtttcagtgatccgtgaagagaccccgagtcttttacatcccggagaatgacaagagagcgagtacctgggcgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataacccagcctcccatggccgggctctgagctctcattctgcggactgggacaaaggggttaactgtgatgcgctttgtataaccccaggattctgcacttgcccaagggcgaggtgcaaatcaaaaactacgcacaactgaacaccgagatcagaaattgacaagcttattctgaaggacctagagtaacctaaataattaggaaaagaaaaacaaagttagaggacttacaccaagtaatttcaagacttattataaagctaaggatcccgactcagattgaaaaagcagaggatggtcactgccttccaggtctgaggctgtctcccagaagcttcactcctggcttcgccttggt

SEQ ID NO: 264375 - DNA, 398 bp, Homo sapiens
ggttgcagtgagccaagatcgagccactgcactccagcctgggcgacagacgagtgagaccctgtctaaaagaaaaaaaagatgagttcttgccagcttgttctaaagctttcactgatgagtgctgaacactttgcagatgcaatgttaacaactgctgcaacatccataaacagtacagtgacacccctatttccaggtgaggaaactgagctcagagaggagagggacccagatcaggggaacccagcagggaagtgggggcccaggttttgaaaccaggactgtctgatttcagaccctaagaccaactgggctccaggcctcctggcttagacaatttgggacccaaacaaactttctcactctctggccatgggtgctgtgggaaactgcct

SEQ ID NO: 264376 - DNA, 586 bp, Homo sapiens
ttgattctcagcttggctgttgttggtgtatagcagtgctcctgatttatgtacattgattttgtatcctgaaactttactgaatccatttatcagatctaggagcttcttggaagagtctttaggattttttaggtatatgattatatcatcggtgaacagtgatagtttgacttccttttttccaatttggatgccctttatgataagtgtgaagacagtgaagaccaaaggaactcaggataggaagagattcccaagatgaggttggaagagcaggtaggatttaacttgagctttgaaggataaagagtatttaaatagtgaagataatgttttacacaagtggtagcatgaataaagatgtgaatttgggaataaatacaagaggtatattcaaagcaagcaaatagaccagcccagttggaagagatgactcaacaatgttgcagtcaaatgcccagttagttaagaactacaaagtaaaatatttcagtaaaggatcatttgacaaagcaaaagacccagaccctcataaaggctaccagtctcccctgctacagaaaaatgcagaaaatacataatg

SEQ ID NO: 264377 - DNA, 343 bp, Homo sapiens
gcaatgtctccaccctccaacctccaggaatgtttcatacctttcttattacattggtcgtgttttgtgtgtgcttgtttcattaccattcttttttccttccttcatttggtaggtctttgttgtctttgttgagcacttatgtgtcagacactatgctttctaattgggttgtaataaatcatgcattaaatgtagcaattgccacatttaatagcagtctaaaggcctggcgtggtggctcatgcctgtaatcccagcactttgggaggcctaggtgagaagatcacttgaggccaggagttcaagaccagccttggcaacatagtgagtccccatctct

SEQ ID NO: 264378 - DNA, 426 bp, Homo sapiens
gagaatcgtttgagcccaggagtttcagaccagcccttgcaacatagtgagaccctctctctacaaaaaaatgttaaaaactagccagatgtggtggcgcacacccgtagttccatctactgggattgctgaggtaggagaatcgcttgagcctgggaggtcgaggctgcagttagctgtggtcatgccactgcactccagcctgggcaacagagcgagaccatgtctttaaaagaaaaaggcgtattaatcctgtggcaattaaataatcataggagataatagctgctcttaaatttgggtgctgtttttgtgcatagcactcattttatcagagctaattggttaaatggggactgttgaaacttaaggaatttctcctttcacacatttgagtgcttactttgaaccggatactatacccag

SEQ ID NO: 264379 - DNA, 436 bp, Homo sapiens
aggttgttcctggagactttgcgtgaaggctggtgttgacctgaagccctcctgcagctcgttttgcctcccttgtgtttttccttacatcttttcccttctctggcttccatccattctctgtgaagaggcagctcactaggtgagctgtggctttagagcttctttgcattcagtagatttccaggccattttctccaggcttttagtgcatggcgaaggcatcattggatgagtatcatcaggagggaaagggcagatggctgtgtgtggactgttaaagcagtgtgtgggcacggtggcacgcacctgtagttctagccactccagaggattgcttggagccaggagttcgagatcagcctggcaacatagcgagaccctgtctctaaaaaaacaaaaaagtttacaaatctaggcttttaatctgtatata

SEQ ID NO: 264380 - DNA, 425 bp, Homo sapiens
caagtcctagttgaactaaatgattactgtacatctgaaatggaagcaagacaaagaccaattattctaaggagaaacaaaagagggcagatgtcttaaggtgaatccaaaactaaaaggtccatatccaggccgtaatccaagcagaggtgtgaacaggatatgagaaaaaatctaatacctgtcattggtgaaagtacttatgagtggtcagttggtactaagaaaggggcgtggagaaaggaaatacgacagcaattgtacccactttgggatagtgatattcataaaaagaatttccttgggagcagggataaacatcagaaaacagagttttagaaaaagagaagatcaagaagtaccacgttcgatgaaacactgagttataggacagtgagtatcattgatagaatagaatttaattt

SEQ ID NO: 264381 - DNA, 409 bp, Homo sapiens
gatcagaccacatggcgttacagtcccttccactctgagagggagctgtgtgatgtgcacaaatgccctgtacttctcctatgacaactcgcagggccctatcacagggagatcccacagcaacaccatgactgtcaaacagcctcagtttccagacgctcctcagacatgtccagcctggcttcctggaagctacttctgcatcttgtagaagagtctccagggcatttcagaaccaagggaaacattgtagcctattggaaacctaaccacatgggatccactgtagctaatgcaatgtaagttatccacatgcaatgagggaatatttcaataacagaaacgctccccttcccaagttgccttctttttttaggctgttaaaacataatttgcctgacagcccacc

SEQ ID NO: 264382 - DNA, 660 bp, Homo sapiens
agagtcctcccatcccaatgggtatgccagcttgtacatgtgtcactctatggtatctgttcatcctagactcacattgcacaacgtcctttgattcttcccttctgtgaggcttgtagtctaaatgtttgcaagcatcactttgcatctgtccttgagagaaccttattttctgtgtttctgaaccttctactgttttattaaagttacctggaatcctgattacaacaccctcaaataactactctcttaatatccattgatgccaccttcccacttcatggatctcctgtagagaacattattcaaggatttgatgatgaaaaagaggctaaatattactggtaggagaattaacttttatggctcatgtttcttatattcctgacctgaaactgaattcacttatggttgtgtgatatagatcttatttgtacaagttattaaataataaattatgctaagcaatatcctatgtcctgtgaaagtcaacgttgaatatatatcatttttcttgaccaaccttgtccaagtggtctcctgattcataagggctcttatgttcctgaaagaaattaggtaaccccgagagattttgctattccagaaacaatgttgtgttttatttataatctatcaattgttctccccagtattttc

SEQ ID NO: 264383 - DNA, 418 bp, Homo sapiens
atttctgttttcttttaagataggtatatttcagaattatacaagactaccacattgtgaataataattaacatctgtgtgctattacctcacttaaagaagtaaacattagcaatgcaatcgaagccctttctacagccctccacaattacaagccccttcactgctctcaggtaaccagtatcctgaaatataaattcattattcccacgaatttttttagaattttactgactctatgaagtaactctacccatatatagcatcgtttgcatgttttaaactttgaatggtttgctttgtatattctccaacttgctgtttttgctcaacaggagcgagttaagaatgaggactttgttttgttcactgctatatccagagaacctagaaaagtgcctgacatataggaggaact

SEQ ID NO: 264384 - DNA, 313 bp, Homo sapiens
gttgccagcagtggtgggtagggttgaatagatggagcacaggacatttttagggcagtgaagccattctgtatgatacaaccattagagctgcacaagagtgaaccctaatgtataactgctggcttttgttaataatattggttcatcaactttaacaaatgtaccacactaatgcaaggtattagtaacaggagtaaaatgagggattggaaggatatgtatgggaactcactgtattttctgtgcaaattttctgtaaacctaaaactgctctaaaaaatagtcgattaaaatttttttaaaaaaacga

SEQ ID NO: 264385 - DNA, 2055 bp, Homo sapiens
  misc_feature (25)..(25): n is a, c, g, or t
  misc_feature (336)..(336): n is a, c, g, or t
  misc_feature (1175)..(1175): n is a, c, g, or t
  misc_feature (1822)..(1822): n is a, c, g, or t
  misc_feature (1858)..(1858): n is a, c, g, or t
  misc_feature (1898)..(1898): n is a, c, g, or t
  misc_feature (2047)..(2047): n is a, c, g, or t
  misc_feature (2050)..(2051): n is a, c, g, or t
  misc_feature (2053)..(2054): n is a, c, g, or t
tatctgagttcatacaacagctacnatacatccaagcagtatgaagatgggcaagttatttaactcatgggagcctcagtttcctcatctgtaaaggagagaggctaagaatatcttccgtagaggactgttttaagaattaaattacatgtaatattatagttcgtctaaaaggaagggatgcttatttgtttcatttcactgttataacactggtacctaaaatagtgctggcacttggtaattctccttaagtgttaataaaaaataaatgagataactgttcgaatctcacgtatttcatgttactttcaagttgctgcttttcacatctangagttctttcctcatgctctgagacttagtccttcgcctctccggattttattaaatgatggatgttctcactgtcagtgtaatctccaaggtcctggcctttcctgaactggggtttgggtgcactgagacggtaactacagccttactaccccactactcaattctttactcaagagaggctgcttagaaagtctgggtctgcagaatctcatagtgattccaatctattagatctgtaggatatttccggataacatatcatgtgctttggtgattgtttctgaaaaggcaatagacttgtaagtgttctatgtgtcatgcatattggaagtacactaaatatattactacttcactggggactctcttgacaataatgtgaattgctgagggaacagaaatcaatttttaaagtgtttctgacatcaaaggtgaccgctgggcttcaggaaaagagttcaaagtaagattgacttcgtgattgagatattcataagactcacactgcaaaggtaggttgggcattcttccactgcccaagatgcaagcgaatgatgcaggcagattccaagctgagtttgctgagataagggcctccaaggaactgagttccggcaacatgcattgtgagtacccataccatcaggtctgtctttgtattctgttctctgaacctaaaatgccccttcttcagttctctattaaaccctcttcacctgcacatgcttcaatactcatctcaaatgaatccatttctggctggcagagtttttcatctatcatttttttctccctgtcttatagcaaatattggatcctaaccttagttattttcncatgtaactcttttttttaccctacgatccttggcaacaggggatatggcttacttatttctgtgtctccacaccttgcttagcatagagccaaaccaattttttttttaattatcatacttcaggtttagtagtatctgcaaaaaaaaagtattctttatacagtattatctaagtggaaattttattttaaaattcaatagaaataatataaattagattttttttaaatctcaatatgatggaccaggttggccaaataccatccacagtgagggttattaaacggtagattcaaacagcagcatggtccatcagaaataatactttattcatttacttcaccatttattgtgcacctactatgtgccaggctaaaatcataagcagcttacattttacaaagggaagatataatatgcagctgcaaaatgccagcaagaaaaaaatataattttgtgataaaagtctgtaatcaagtgagtaaagtagaatattataaaaggcatcagggagatggtgaatttggagctggattttgttagctaaacacatattgtccaagccaacagcaaagggaaaatttgggccatcttagctacattaaatggctacacagtccatgtcataaatgcaattataagttnatggtggtctatgtatttggaaacactgactcaatnttcagcaaaagtggtttgaaaatgaaatgggaaaatacantaagcaagcagagaccataaaagaggcactaatgacataaacattcaaccttccttacaaactttgaaacagaaaaatggtggttgcccagttttttgttgttgtttgtttgtttttgagacggagtttccctctgttgcccaggctgnagnncnnt

SEQ ID NO: 264386 - DNA, 373 bp, Homo sapiens
gaaattataataaaagttaaaactaaattacagcccagggcagcagtttcaccaacttctctttttcctttctcaagaagatagatcgggggccaggtgcggtggctcatgcctggaatcccagcactttgggaggccgaggcgggcagatcacaaggtcaggagttcgagactagcctggccaacatggtgaaaccccgtctctactaaagatacaaaaaattagccaggcgtggtggcacactcctgtaatcgcagctactcgggaggctgaggcaggagactcgcttgaacctgggaggcggaggttgccgtgagccgagatcacgccattgcactccagcctgggtgacagggtgagactctccatctc

SEQ ID NO: 264387 - DNA, 571 bp, Homo sapiens
aatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatct

SEQ ID NO: 264388 - DNA, 532 bp, Homo sapiens
  misc_feature (46)..(46): n is a, c, g, or t
  misc_feature (49)..(49): n is a, c, g, or t
attcggcacgaggaattacaggcatgagccactatgcccagccacnttnttaaccttaaagggctctgaatatggagatagaacactggagtcgaagtcccagccccctctgtcgctctctctgaagctcagtgactactccagtattaaatgatgcatgtataaagttagtcactctatcattatctgtaatagcagatgattggaaatgacctaaatgtctcataataaggaactagttttaaaaagcatgttccattcatgccttgaaatactatacattgaaaaaataaaaattgtataaatatgtgaaaaaaacagtgtgtatattatactacgacttacttctttgtgcatagatgttctacaaggctatataaaagattgttaattatggttgtctcttgggagggggagtttagattgtataatggggtagaaggctgacttttcgttgtttactattctgcaccttctggattttgtactatgtatatattttatatattaaaatagctttatataaataaaa

SEQ ID NO: 264389 - DNA, 570 bp, Homo sapiens
  misc_feature (46)..(46): n is a, c, g, or t
  misc_feature (49)..(49): n is a, c, g, or t
attcggcacgaggaattacaggcatgagccactatgcccagccacnttnttaaccttaaagggctctgaatatggagatagaacactggagtcgaagtcccagccccctctgtcgctctctctgaagctcagtgactactccagtattaaatgatgcatgtataaagttagtcactctatcattatctgtaatagcagatgattggaaatgacctaaatgtctcataataaggaactagttttaaaaagcatgttccattcatgccttgaaatactatacattgaaaaaataaaaattgtataaatatgtgaaaaaaacagtgtgtatattatactacgacttacttctttgtgcatagatgttctacaaggctatataaaagattgttaattatggttgtctcttgggagggggagtttagattgtataatggggtagaaggctgacttttcgttgtttactattctgcaccttctggattttgtactatgtatatattttatatattaaaatagctttatataaataaaactagccccatggctgaataaattttattacaattttat

SEQ ID NO: 264390 - DNA, 784 bp, Homo sapiens
agcggggggggcccgtccgactcgacgggtgagcccgtggttcccggctccgcaccgtcgcctgcctctctgcatgaccaccccgcgtacccgtacccctcgatgccgacttccccacgctgcccctttcgcttaccccatgacgcggggcctcatgacgcaggtgtctgtggccgaatgaggaacttccccgacaagaagtgccgagcttaaggacgctactaagggggcgggatcgccatgtggattttgttttaggtgctgtctctcctgttgttgttgtcctttacacgatggtgttgcaagaaaatggatatggtgttgaggaagacattccaacattactaatggctgctagcagtatggatgacattctggctatcactggattcaatacatgcttgagcatagtcttctcctcggacaaaacttacgttgaagagaggattccttgtttggactacgtgtgtttctgctgtcttaggcagccaacgtatcggtttacatggatctggcaggattatgcacactagtgttgagtttcattgcacgggacaaaatggtcccaatgaacacgatgaaagtccaaaagattattaccaaatgtgtgggactatttttcaaccacttctttatggtataggttggacgcaagaagtatctgttcatcgcttgaactcacatatcgtggcatatctgctggcactctgagtttgaaccttatgtgtccacatttgaaccacatatctattgatgtgctatgtggtttaggattaggacgaac

SEQ ID NO: 264391 - DNA, 653 bp, Homo sapiens
agcggggggggcccgtccgactcgacgggtgagcccgtggttcccggctccgcaccgtcgcctgcctctctgcatgaccaccccgcgtacccgtacccctcgatgccgacttccccacgctgcccctttcgcttaccccatgacgcggggcctcatgacgcaggtgtctgtggccgaatgaggaacttccccgacaagaagtgccgagcttaaggacgctactaagggggcgggatcgccatgtggattttgttttaggtgctgtctctcctgttgttgttgtcctttacacgatggtgttgcaagaaaatggatatggtgttgaggaagacattccaacattactaatggctgctagcagtatggatgacattctggctatcactggattcaatacatgcttgagcatagtcttctcctcgggctgtgctaggtcctctggctctagaaacagcaagagtctccgcaccccacttggaaccatatgcgaaggatgtgatgacagtagcatttttagccatctcgatcacagctccaaatggagctctacttatgggcattctggggcctaaaatgcttacacaccattatgatccaagcaaaataaaactgcaattgtcaacattagaacatcattaaaaagtttacctgtc

SEQ ID NO: 264392 - DNA, 519 bp, Homo sapiens
aatttcacaaatactaatttggatacagagaccatcaacatgacagccaaggatcaaacccctgcatggcagcagcacctcattcatgctaattgacagtttcacgtgaccaaatctggtcagaggaaaagcaagaaagcaattctaaaacagaaatatggccggacatggtggctcacccctgtaatcccaacactttgggaggcagaggcgggcagatcggttgaggccagaagtttgaggccagtctggccaacacggtgaaactctctctctactaaaaaaataaaaataaaaattagccaggcatggtggcgggtgctggcaatcccagctactcgggaagctgaggcatgagaatttcttgaacctgggaagcagaagctgcagtgagccgagatcgtgccactgcactccagcctgggtgacagagtgagactccatctcaaaaaaataaaagaaaataaaattctgaaatatctgaaagggctgtaccttccacctaaaggaacactggca

SEQ ID NO: 264393 - DNA, 593 bp, Homo sapiens
aagtagaacctcatctagaaaaaattagaagtcatttggctacaagaaatcatgaaagaagaactgggatgtgatgttttccctgatgtttttcgttggctccctaatggaataggttcccttactgttctggcatacagattctctttgtgattctcattcttgtgtgaattatatgtgtactattcaaataattaatgctatatatttcctgcttctgagaaaactgattttatggtatctgaagactagaaatgattcaacgagtgatagctgcagacttaactgaggtctctctctcctcctttttttcttttcttctctttttcttttttttctactcggtgtcacccttttattgggcttttgggtgctcttaaaaattcctcagtgaggcagctcctttcctcccctgccctcaccgtgggaaagactatctgggaatgagctttcctggcaaagagggacacgttggctgagcttttgatcatcaatgctttcaagaagaaagattttttaaagaatttttatctgaggaatgtgagccacttcacatgatcagagagacattaaatcaagacagcaaccacatt

SEQ ID NO: 264394 - DNA, 454 bp, Homo sapiens
tgatagaatttggtcaatagaatcccctttctattatcaaacacctaaggagacattgaagtataaaaagaattaggcttctccttgtaagttaaaaccaaaagaaatgaaagtctgtatttctttccaacccattttcttaattctgatgactctcagccacagagtctcagttagatacctgcatagaaacagggttactcagcagttttattgataatttttggcttaagatttacaagttaattcagaacatttaatatgtcacaatacttaatgaggccagagttaataatgcaaataggattattatagctcacaaaattacaaatgtgcaagaaaattttcagaccttatgataattaccctaggaaaaagaaaaaaggaaatggtcccatatcttgacacttagcataagccagacacacattgcttactgttattaaaaaatggc

SEQ ID NO: 264395 - DNA, 589 bp, Homo sapiens
caaatccacatttatttgagtaattgtacttggttttacccatctttctactgcagccccaattataaataccatatggaccatacttttatatgtctctgtctcacatcatgcctcctgatcacacacacaaaaaaggttccgtaaggtttaaaaaatggctagaaaagaatggaagagtattctccgtattcttagatttaacaatcattttatttccatccagaccttatggaaagtccattggctgaaaacagaacagacaaacaaacaaacaaataaccctgaatgtttcatagagactgcccagaataacaggatgtattgtatggcctttggacatggtgtgcttcctttacatttgccaattcaagagcttatggttgggatgatcatataggccagtttgtctctgacagtcttgctttttgtgcctgtaattatcgataatatcttcccttcactctcaaaagagttctggtttagatgagaaagtatatggtcactctccctaaggaccatttttatgggcaaatattatagaactgggatagattagcatctcacccatttcttcccaaagctttag

SEQ ID NO: 264396 - DNA, 127 bp, Homo sapiens
ttttttcactattggatatcctattttgtgaggtgcctattttaaccttttgtccttttttctgtcgattcataggaattctttatctattctggatataattcctttattgaatacatgtattgca

SEQ ID NO: 264397 - DNA, 401 bp, Homo sapiens
tattattatttccaaagacagtccaccctaattaccaacaggcattcccaaactcttcttagtctatcattaatctcatcctttcttctatctttagatatttggtagccaagggctgggcgcagtggctcacgcctgtaatcccagcactttgggaggctgaggcgggtgaattacttgaggtcaggagttggagaccatcctggccaacatggtgaaaccccgtctctactaaaaatacaaaaattagctgggcatggtgtcgtgcacctgtaatcccagctattcgggagactgagttaggagaatcatttgaacctgaggaggcagagtttgcagtgagctgagatcgcaccactgcattccagcctgggtaacagagtgagtgagactctgtctaa

SEQ ID NO: 264398 - DNA, 232 bp, Homo sapiens
cacagtagccacctctcagtcacagcatgacttctggaacttgtgcctgcttgcttcaaacccaccgattaaaactccctgcaggaaatctgtatagagaatgccctagactccaataaaggcaagggtccttctgtctctctccctcacatgctccctgacttctgtgtgtgtggcctctgggcatgccgtgtaccctcaggacctgtaagtaataaaatctttatttcca

SEQ ID NO: 264399 - DNA, 392 bp, Homo sapiens
gagaacgtatgtactcacattctgtgaccatatggggcataatgttatgtgtatgtctctgtaagtggaattaagggtgtttagcttgctggttttagggttttttggggtttttttgccactcttctccagtaggaatctcctcccctagcacagggtcaataaactttttctgtaaagggccagatagtaaggctttgcaggccaaaaagtaaaattgagaatattaggtagatatctagttaacaggaaagaaaatttttttctacaaacttttttttttttatgaaatgaaaaacatttatttatggaactaaaactttaatttcatattattttaaggtatcacaaaatattattcttttgatttctttcccaatcatctaaaaatc

SEQ ID NO: 264400 - DNA, 443 bp, Homo sapiens
ttgtttaggccaagttaaaaggcactgttaaggagcacactgttaaaaggcacacctgattttccctgaaacaatctctgtacatgctgaaataattggattcccatcagaattctgcttaaggtaggtgacaactaactcctgattctttggagaaagatcagaacaaatgtctcatcaggagagagatttgaacaagtccctccctcagcctgatgtttgtcttcccagtctgtggcaaaatacatacactgggagggaaagaggcatcgaagaattgtgaaagaaaggaagaaaggggggaaggaaagaagtaagaaaggagaaaaagagaagatgctatatccaccagctacatttactctaatacttgatgaacatattacataactatcagtataagtgtgttttacctcgtaaatacaaatctcacaccttgtaaa

SEQ ID NO: 264401 - DNA, 444 bp, Homo sapiens
cattataaagcatgtacatttttaaaataagggagtttcaggtaagaaataatgcaagcaaagaaatggaagcaaatatattgaaggggtaatgatgactaaaccagtccaatttgaggaaaggatttaatagagaaagggacaaatgttccacatgattttggggttagttcatgacagttcttgtggggctgaggtgggcggatcaggaggtcaggagtttgagaccagcctggccaacatagtgaaaccctgtctctactaaaaaaaaaaaaaatcagccaggtgtggtggcgtgcatctgtaatcacagctatgtgggaggctgaggcaggagaatcacttgaaccctggaggtaaaggttgcagtgagctgagatcgagccattgcactccagcctgggtgacagggcaagactccatctcggaaaaacaaaacaaaac

SEQ ID NO: 264402 - DNA, 494 bp, Homo sapiens
cagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattac

SEQ ID NO: 264403 - DNA, 230 bp, Homo sapiens
tacactgtacttacatttacttgacccaaattgccgtatcaatcacatctcctatcccttttgcagttccaggttggaatcagtatttcaaataaagtagggacacatctaaaatatttgtgtatcggtaaaggtgtttctggctatttaaactcaagcatcctttgccacagtagtatctccgttttgcacggtactactgtctctcaaaccagttacatctgaaaacc

SEQ ID NO: 264404 - DNA, 569 bp, Homo sapiens
gatgatggttcctttccttacctaccctgctgtgtgcaccaggtcaagattttttggacctgcagataaaatgtttcagccttaggagttccccactgtaagtaaaattttctggcaagctcaatactaccatctgatgagaacaatgtagtctgttagctgcctgcaagatgactagtctatactcccaagaaaacacccccttcagaacaatagagaaggaactgttttgcatgtggaccacttaaggtccaatttgaggctggtttggggaaaacatccactcctcctcaaacctatctttagacttaaagtcaacttaaatgtcattgagtttcccaccctgggttaagcactttcacttatctttgcttacactatttttctatctaaacatacatttttaaagcagaaatcctcatttaatctttaaaacagatctgtgattttgaaacactatttaatcaaaattcagaattgtggtagcatttttgctgtttgtaagttaaacaaaatagattgtaagtgtgcaatgccattcattcattcaactaatgtgccaataattt

SEQ ID NO: 264405 - DNA, 331 bp, Homo sapiens
attatcttttatcccaaggtatgatcttttattcctgtatatattcaatcttctgtaggtttcattaggccctagaaaatatagctttcccttctgtacttgcaatgggaaataaaactgtctgctggattggagagtttcagatgcttattcattcatcttttaaagatcctatttatttcatttataatccatttgtcttcttcttttactgacattccaaatgtcagattaagatagggacatttaggaactacatgaaaggaaaagtaaatgggcataatatatacatttgtgatgaatgaagaccttttttcctgtacaagaggat

SEQ ID NO: 264406 - DNA, 305 bp, Homo sapiens
ctccatccgtccagtggcgtaagactcagccataaagaggggcgaggcgctggcacaggctaaagcacggaggagcctcggaaacacgacgctgcgcggaagaagccacgcacacacggccgtgtattgcgtgattccacggatgtgacacgtccagaacaggcaagtcctcgcgaacagaaagcacactagtgtttgccgggggctggtgggtggggcaatggggagtgactgcttacaaggtgtgggatttccttttggggatatgaagatgttttggaactaaatagaaatgatggttgacc

SEQ ID NO: 264407 - DNA, 393 bp, Homo sapiens
cacgaggagaattcaaacagcatgaacattttcaaggctcttaacacatattgccagattatttccataaatatcatatcaaattatactctcaccaatcatatgagtgtctgtagtctggatgcagtggctcacgcctgtaatcctaacactttgggaggccaaggcaggtggatcacctcaggtcaggagttcgagaccagcctgcccaacatggtgaaaccctgtctctactaaaaatacaaaaattagccaggcatggtggcaggcccctataatactactcaggaagctgaggcaggagaattgcttaaactcaggaagcaaaggttgcagtgagctgaaattatgccactttactccagcctgggcgaaagagtgaaactccatctc

SEQ ID NO: 264408 - DNA, 419 bp, Homo sapiens
aataaggtatttttcttggttgagaagaattactggagttcagcattttagtgaacagctgttactctgggataactatgatttcataacagttgtaaagcctattgttagtactagagtctgctgtttacatgggacactgctgggtactgttgaggaaaccaaaaggcatgatctttgtacccaagaaaggtagagatagattgtaaacaccacccataggaaactattcataatttccacctcataggtaggcaacagagtctgttggttaaagggcaatctatgaaataatatggccttggttcacatcttgtctctgctatttacagctttgtgtcttcttttccttagctgtcttatctgaaaattgggtatatcaatcacacctatcttaaaaaatattatgaggattaata

SEQ ID NO: 264409 - DNA, 357 bp, Homo sapiens
  misc_feature (335)..(335): n is a, c, g, or t
  misc_feature (344)..(344): n is a, c, g, or t
gacattctcttacacaaccacagaacaattatcaaaagcttggaaactaacattgatacaatactttaatctacatacctcattcagatttcaccagttgtcctaataatgtaataaaattatttctggattatgtctatctcatttatagtaaaagaaaatcctggatcatgcattgcactctgttgtgtatctttagtctccttcattctgaacacttcctcagtctggctttatctttcctaacattgacgttttataaaaatacaggccagtttttttttcctttttgagatggagtctcagtctgttaaccactgcactctagcctgggngacaaagtnagactccgtctca

SEQ ID NO: 264410 - DNA, 481 bp, Homo sapiens
gacattctcttacacaaccacagaacaattatcaaaagcttggaaactaacattgatacaatactttaatctacatacctcattcagatttcaccagttgtcctaataatgtaataaaattatttctggattatgtctatctcatttatagtaaaagaaaatcctggatcatgcattgcactctgttgtgtatctttagtctccttcattctgaacacttcctcagtctggctttatctttcctaacattgacgttttataaaaatacaggccagtttttttttcctttttgagatggagtctcagtctgttaaccaggctggagtgcagtggtgcgatcttggctccctgcaaccaccgcctccccagttcaagcaattctcctagctactcgggaggctggggcaggaggatagcctgagcccaggggagttggggctgaagcctgggtgacagaggaagaccttgccttcaaaaaaac

SEQ ID NO: 264411 - DNA, 337 bp, Homo sapiens
gctgaaatctttttcatttaattttatatttgttggggtttaaaaatcagtgcaggctgggcacagtggctcatgcctgtaatcccagcactttgggaggccgaggtgggcagatcacctgaggtcaggagttcgagaccatcctggctaacatggtgaaaccccatctctactaaaaaacaaaaactagccgggcgtggtggcgggtgcctgtagtcccagctactcgggaggctgaggcaggagaatcgcttgaagccgggaggtggaggctgcagtgagccgagattgcgcccctgcactccagcctgggctacagagcgagactccgtctcaa

SEQ ID NO: 264412 - DNA, 392 bp, Homo sapiens
tgcattctgctgtaatgaaatgaatcataaaatatgttttagaagaaaattactataaaaagtttcaaaattgttatttaaaaaggaccccgccaacacgcatattgacccaaggaatcttcgggatggactctgcttctgatcacatcttcacctgctcgaggatcacctgtggcacgtcgggctctgaatgcaagccccaggacaccccatttcatgcgtctgcattcttaacctcactgcccattaacatgcatctcaatgcatccaaaataccgcacccccatcacatcagagagcattaaaaataagccagctcaatgcacaaaaatgagggcgacaatcggaaacacaatgatgtttctaaagaatgtccaaccttaactgcagct

SEQ ID NO: 264413 - DNA, 463 bp, Homo sapiens
ggattgagaaaatggaacagtactgactccaagttagagaaaagcttgtttacttgaacacaattattgctttgcttgagtctgcagattattaaaaatgccttgggaaaacaggaccttcaacagaaataaaagaaaatacaccaaccaacaactctgagaaccaacaactcactctgggactcaacagctctgggaaccaacagctctgggaatgggctggccagcctaagaataggctgatggtgcctgcagaaggccacaaggcattgaccaagaaagcaaggattaactgcccatctgagactctgcaggtttcacaagggtgctttaatcatctcccttaatttcccttaaaaacccctgatctggagtcacaactccaggggaggtgatctttgaaaacaagtctaccacccagaggttgctggcttccttaataaagctaactttcctttcacca

SEQ ID NO: 264414 - DNA, 691 bp, Homo sapiens
gctaacatagttacagtttccaaggactaggatgtggacctctgaaagactattgttctgcctatcgcaccaaccttcctgtctttctgtttgcctgttcttgacagccaggccatgaacaacttctcatgagtgtatatttgaactatgctccactcctcttttcatccaaagtgtatgaataggtctacaagctgatgctttgaccatgaggaagattttttttctcactactttctttcaagatcttcattgagtggaattctactgtggtcattaacctgtttttgcttgcatcaaagtatcagccaaccagtcaggaatttttactaccatatgtctgaactgagctgtgcaatagtggtggatgacatgaggcccgtataatctgatgatgttgcttgcttgtgccttcagttcctgcttgtagtcaatcctggctaacctatgtccatcttaaaattggttatttctgggtctgtctctgacttgttgaattttatagaacccaacttatgactcttccggacacatggtcaattatgaggtgttctgtcgctacaggtgcccaatggcaagccaagaggtattttcctaaaagatatgcatttctttaaactgctggataaagatatggttcgggtttctaattttcccattggggcacttcataaactctaaagagtgtatt

SEQ ID NO: 264415 - DNA, 398 bp, Homo sapiens
caacagcattctttaacatcttcctccaccatctctttgctgttcctctcttttactcatctttattttcttagcactcatcaccatctgccacattttatatttatgttttaatatttttcttctctttagagagtaagcatcttttctagagcaaggacttgatttgtttacattttgctgtaatttgctgtgcctaaaaagtgcctagctcatcataggtgcttgataaatatttgttaagtaaacaaatgaatgaatgagccttggtgtgttaaccaatgaatcatttaatgtattgtctaatagcagtctatctcccatgatattgggctttgaaaaagacaaacaaacaaacaaaacaagggagaacaacaagggagaacaaacaaacaaac

SEQ ID NO: 264416 - DNA, 365 bp, Homo sapiens
ctgttagcaagacttcttaaattctgcctagtgataatcatgccataagatcatctccttcagttacctttttttgagtgtgtcccaaccacctagtacagttagttgtgtatgatcttcttgaggagcaatcagaagagacttgtgaaatatcattagcctgttagccttgttccagtgttttgttgcttacccatcaaaactttaaacttatattcagcatatttgtttctgccttaatttaagctcagacttcctttgtagcttcaagggaataaagaacaattgtgtgacatcctcttttttaaaaactttgaaggtaaataagggcaatgtgaacatgagttagtataaaacactgactg

SEQ ID NO: 264417 - DNA, 452 bp, Homo sapiens
accctatctttcaggattctcaagacacagttttcatggagtgataatgaaaggagcagcagccgccttaatatcccagagagagcagacggaccagaaggcaacttaaaccagattgttactgaaccccatgcaaactttccctagttcttgcatgaggggtatgtaccatgccaaggtctttactcccatatcaaccagaccttgaaggaggctcacttcaacagcctgcagcagtgagggcaagctccaacatgatgaattaggacttccttattccaacctaaactgtgtttataaaagtaattgcatacacaccaaaaaaaaagtctattggtttttaaatctaaattttaagtaacaagttaatgggcagttgtttaattggggttttacttcactgctgtacttttaaagaggctgtgaataaatgtttatgaaattaaaaaaat

SEQ ID NO: 264418 - DNA, 666 bp, Homo sapiens
acttcagatagcatggcagtcttctcagtcattcagttctcagctctaaagtccctttctcagatggcataaacagccacccgtcactcacaatactttatgaattcactaaacttatcactatcttaagttagcttgtttatttgtatctaagttaacatctctccccaatagaatgtaaactccatgagagcagggattttgtctgtcttagttgcaacctaaaataatgtcagacacataatagagctcggtaaagacctgttgaatgaataccacccacatagctggaagttgcttgggaaagtggcagaaagatcaagctgactacagaaatcagaaccagcataaaagccagttagcagcttgaacagagggctgaggtacttttttccaactatgtgtcttccttacttctctggcacatgaagcctttacctattctgagcacacaacagggcaaggaggtatacacaacagcctctagggtgcaatgggccaccttcacagttagctgacaagaattcctcatggcaccaaataggcaaagagggacctccatatgtcagtgggagctcttgggcagccttgataccagaaggaggaaagttacccagtggcagggcaagatcacaaagccaacaagcactcactaacccccagcca

SEQ ID NO: 264419 - DNA, 298 bp, Homo sapiens
ctcataccagtcgtgacaatcataccgataacaacactgagctgctcaggtttgaatcctggctctgccactttctacctgcgcaacctggaacaaacaactcaatctctccccgtaccttggttttctcacctgaaaaatgggaatgattataatagtactcgtagagttgttacagagattaaattagataattcagtactgggcacagaaaaggggttttgttttgtttttgagatgcagtctcgctctgttgcacaggctgaagtacagtggcgtgatctcagctcactgcaac

SEQ ID NO: 264420 - DNA, 560 bp, Homo sapiens
gtattggccactgtttggtttgtgtattggtctaggaaagaaatgagaattttattttaaaaagccttccagcaggaccccagcagagactgggcaaacacctcagcgacggactgtaaacagtgggaaggcccagaccctggccccgtggccacgagctgcagccccacggctcacgtcagccttcctgcccttcccgggcctctctcccacggcactcacacacagagccttttcaataccctccggcagaacagaagaatccatttccacacgccagcacgcacgttcctcacaccatcccaggggagtgggccctgccaagaggccagtttatggacctagaaggacagacagggctggggcccatggtcgcggcgggggggtggtccatggacagaaaaaagctcagagccaaatcctgtgctcccaggtcccccagctactcaggaggctgaggtgggaggatagcttgagcccaggaagcagaggttgcactgaaccaagatcacgccactgcactttagcctggggggcagagtccaaactttggggcaaaa

SEQ ID NO: 264421 - DNA, 1018 bp, Homo sapiens
agaagcagatggtcagcccggtgcatccaaggaccagatgcgcgagtttctggcccaaatagaaaaagccagtaagctgctgttacagtaccagttctagattttggatgatgacgtctggacatggaccagaagagaccgttttcaccttcctgggtcaggtgcagacagatgttagcccattgttaccccgattagaacttctaggcctatgcccttgtgtgttgtctttcttttttttttttaacgttaactctgtgtgtttagtagttcattcgttttacttctttgcaggctgaacataacttctttttttcaaagttccctgtgttgtgaactgagcttgggtgaagtgaaatctttgaggtaaggcaaccctaatgataaaaatggaaagaaagcctgtgaaatttgggagccttcagagataacattttagagtcactgcctaaatattgaaatgccgccatttgttgtttggggggatgtggagctaaattgagaacgggagcacacatctgccttgactgctaagtatatccatctctactgctcacccataatagaatttttatgtgtgcactcactagtcttggttttatcaacagtttaaaggaggaaaaagagaatgaagagacttcatttcttggtttttcccttacatgtttgagtgttgtccctggtaggccctagttctttttcattattatcactaaagtggcttttgttctttgtttctttagaaaggacaacagagaactgaaaatacattatttcctagtatgctagtaagaagcagaatattactattccatttttattttctggcagatgaagcttcagagttagtaaagaaaatttccctgtgccatctaatgagtgttactgaacaaaggatttttgaagtctttcacccagatgaggaaccattagatagcacaccttgctctaaccattagatagcacatcaagaaagcaaggtcagttgagaaattgatgctcttttgaaaatatcaag

SEQ ID NO: 264422 - DNA, 459 bp, Homo sapiens
gcaaatttgtcacctagggaacatttggcaatgtctggagacattttgattgtcaccactgtgtggggggctgctactcactggcatctagtggttagaggccaaagatgctcctgaacatccacagtgcacatgacagcccccacaacaaagaattatctggcccaaaacatcaatagcaccaaggatgagaaactgctatagtcttataactagtctccctacctcccatattaagccattccagtcatgatcattataaattccaattccctgattaaatctattttgttattaatcataacttgaaatcccttttcttttcttttcttttcttttctttctttctttcttttttttttttttttgagacagagtctcgctcttttcgcccaggccggactgcagtggcgctatctcggctcactgcaagctccgcctcccgggttcacgccattc

SEQ ID NO: 264423 - DNA, 510 bp, Homo sapiens
tcttcttctttttctttttcttctcttctgtaaaagtgccatcattattagttcatcttacttcaactacacctatttaaatattgaaaaatactcacccacaactcttaaggctggaatgggcttatttttcactgttttaggaaatatgccaggttttcttggtgcttattctggtgggttgttaagaaactgaaatgattgcaaaagttactattttaatacttgttttcttttctttctttttttttttttaggatctggacttacctcaattgcttttgctgcttgttcttttgtttcaaattccacaaacgcaaatccctttggatctccagtagacttataatgtggtatacttatataaacaacattgccacatttcccaaatactctttcaatccagctgtgattaacatttttgggaagtaactcctattataaattaaaagcaatattagagtttttcacaatcagaatgtcaataaatttttaacttaaaaaaaaaaa

SEQ ID NO: 264424 - DNA, 288 bp, Homo sapiens
tgtgactttggaggtgctgaagttaaaaaaaacgggtgctagaaactaatactagacagttggggtgggtcacacctataatcccagcactttcagagtctgaggcagatggatcacttgaagtcaggagttcaaaaaccagcctggccaacatgtaaaacaccatatctactaaaaatacaaaaaaaattagccacgcatgggggcagacatccataatctgagctactcaggaggctgaaggaaaaagaatcacctgaacctgggaggtggatgtttcaatgagct

SEQ ID NO: 264425 - DNA, 314 bp, Homo sapiens
atgacaaatcattgagcctcttcataccccaacttaaggagtatgggccagaaggattggggcagatggtgccatgcaataagctgtaaaagtaaagctgaaggagtaaaggctctttctctaagatattggtgatggcagtgaaggatctgaagtctgagcggtgacctcgtttcattgggtgaattcatctggcaactttgagaaatagactatgattaattaattaatgtatctatgtacgcatacatgtatgtatgtgtgtgtgtaatatacttaacgaatactcataaagaactatgtgaattacataa

SEQ ID NO: 264426 - DNA, 508 bp, Homo sapiens
aatgtttctaaatatctttcataagtagcactatgcaggaaggccaggtctgcttggctgggccagttgactttcggtgaattgatgtgtttcctaatcttcacacctagaagaaatggactgatggctgactcttaaattgacaaagccgtttgtttgtgtatatgaaactgctttaaaaagagagattttgaatattagagtatatattctcctccctacccctcgcatttaaaaggtgttaagttggctgggcatggtagctcatacctgtaatcccagcactttgggaggccaaggcgggtggatcacctgaggtcaggagtttgtaaccagcctgaccaacatggtgaaaccccgtctctactaaaaacacaaaaattagccaggcatggtggcacgcgcctgtagttccagctatctgggaggctgagggacgagaatcgcttgaacccgggaggcggaggttgcagtgagccgagatcacaacaagagcaaaacccgtctc

SEQ ID NO: 264427 - DNA, 677 bp, Homo sapiens
acagaacacttcaaactcctcttacgtgttcttgatttcatcatttagctgaagatgcaggccctgtctttctttctgagttttccttagcaccctccttttaaattacctttttcattggttaaatgccatgaaacttcatcaattctagttttagctatcacttgacccaaagacaagagagttgaatcctggaccttaaagaaaaagaaaaaaggaaaaaaagcttgtgggaaccttatttacctcaactggggaaattttttgctcttgcgcaaaggtcaggtcccgtgaaacttgtgaaataggtgtttttatctcttttcttttccaactgatcagatagatatctttccaggaatttggtgtcagaaatcaaattcaatgagtgggaagtttgacaagattcaggatagtcttgccaaatagcacaagagaggaggtaaagttaggtcaggtcaagggggcagcaaaaatgaagtttataacagatatactgtatatttgtcatgggaaagggcttcagtcaatagcaattgatattaataaaacataaaagaaatgacaataaacaatcaggataactttgaaacaacttctttttatgtaggtaacattaaagaaaattaaagaaaaggaatcgctttattttataaaataaatgcactactatttgc

SEQ ID NO: 264428 - DNA, 1068 bp, Homo sapiens
tcctgtgatgcgggcgtaccttgctttacggcactcatgtgcaggcgtacctcgctttacggcacctccatgcttagttgagcttcaaagatgctgcgttttttttcaccagttggaagtgtgtggccacctcgcattctctctgtgttacgtgttggtggttctcacgatctttcagacttttttattgttatgacacctgttacagtgatctgtgatcagcgatcctccatgttagcattgtcattgttttgggcaccacagaccggacccggcaaccttcatctatgaacgttgtgtgttctggctgttccgcccaccagcctttcccagcctctctcctctccccgctccagcctccctattccctgagacacaaaaatatccaagttagtccagtgagtaaccctacagtggcctcgaggtgtgcgtctgtcactttaaatcaaaagctagaaatggttcagtttagcccgggctcggtggctcacgcctgtaatcccagcactttgggaggccgaggcgggcagatcacgaggtcaggagttcaagaccagcctggccaacatggtgaaaccccatcgctactaaaaatagagaaattagccgggcgtggtggcgggcgcctgtaattccagctactcaggagtctgaggtgggagactcacttgaacctgggaggcagaggttgcagtgagctgagattgtgccgctgcactccagcctgggtgatagagactgtctagaaaagaaagaaagagggagagacagaaggaagagagagagagagagagaaaaaaaaagaaatgatttagtgtagtgaggaaggcttgttgaaagccaagataggctggaagcggagcctctcctaccagttagccaaattgtgaacacacaggaaaagtgttttaaggaaattcaaagtgcttctccagtgaacacaagaatgataagggaaacagccccactgctgatatggagaaagtttgagtggtcggataaagatcaaaccagccacaacgttcccctgagccggagcccaatccagagcaaggccctcgcactctg

SEQ ID NO: 264429 - DNA, 602 bp, Homo sapiens
tcttgtttcctgcacttcagcatggttgagagtgacactccatctcaagaaaaaagtcatttcaatgactacctcaggagattcataggtatctgaccgacatctgagatgggatttgcattgcattttcgctatgatgagaagaaatatttaatgtcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagagagagagagagagagaaaaaaaaagaaatgatttagtgtagtgaggaaggcttgttgaaagccaagataggctggaagcggagcctctcctaccagttagccaaattgtgaacacacaggaaaagtgttttaaggaaattcaaagtgcttctccagtgaacacaagaatgataagggaaacagccccactgctgatatggagaaagtttgagtggtcggataaagatcaaaccagccacaacgttcccctgagccggagcccaatccagagcaaggccctcgcactctg

SEQ ID NO: 264430 - DNA, 859 bp, Homo sapiens
aaagaatgcccaatcatctgcagaatggtaggaaaatattgtgactttttagtggctcttgcccgagcctctccctacattgtggcagtcttaaagcagcagaagcccagtcccctcccttgaactggagaaaacatgctagaccttttttgcaaattactgtgtacatttttttctaacctgtctgcggatacttgaaggactgacacaaggtcacatgtttgttttgcctaactggtagggtgggcactgcttacaaaagctgcaaagaaccacaggtgcatggggcaagaggttatgggtgtaaacataaaatagaacaactaaggcccagaggagaatctggggtaagactttgggaaattaagaacagttacatatacaggggggatttaaaatgcgacatgcatgcccagggaaaacacttgcccggaaagttctaagacccaagctttcaccttggtctggtccctaagcccaaaagcaggccaaagtaagtattgaaggattacctgggacaaagctgatttgtaaaatctaggattgctcctagcattcaagggaatttatgtcaaaatagctgaacgtgacataaaaggaagagagacttcagtgatcacacacagaaggaatagtcttttataaaaataatttggaaaactctcaaaacaaatggatgacagcttttaaaaataaaaaaacaatgaaccagaaaaccgtggggaaaggaaagaatctcatacctagagttaccatattataatagtgaatatccaactctcaaggaaaaaaatcacaaaccatacaaaggaacaggaaaataatgcgcattcaaaagatcaaaattaattgaccttgt

SEQ ID NO: 264431 - DNA, 2090 bp, Homo sapiens
catggttggccattaagaaatgtaatccaaaatatttacaggctcagttaagtactataagcaatgcaaaagttaaacaacagtagaatgtggtagattcatacagtggaatactacactttagaaaaaaaatagataactttatttagatatgttaatgtggcttactctcacaaacttaatatgcagtggtatgattaagtcacaaaagaatatgtacaatataattcagtttaaataaagttcaagaacacaaaacagcaagttggattgtttataaaaggtttactggacactaaatctataaagataataatagaaattattttaacacatccttcaattacctttcattcctccagaaatttgttgaaacctcttgaatgcctatgacctttctcatttcctccactgtttaatttccttttatactttgtttaaaactttgaatggacatatgagagatgaagtcatatttttctaaataagttcaaaaatattttgctttaaaatataagtagtgattaaatttctaagaattgagcaatagttgaatgttataaatttagttttcatgaatatttctctctccacatttcttcttctcaacttgctcatatcccttcaaatgacaaaatacttagaagtatttgagtcaagttagatatatttttgaagatattatttgcttatttatctatgagaggtcaacaacaacttccatgaatattaggaaagcaaatgtcggtagctctattcacttcaatattgaattcacctatatctgaaatttaaatgtcagtgataagactgacagaaagcgtcacacactttaggtaacacagcactaagtggcaacactttaatattgtcactattacatttttcagatatacaatatatactttaccaagaatcctagtctattatgttctaaggatgagctgtctttatacaaattcacaataaatagctgtgtaaataagagttaccatttttattttatagcataaaatgtatttcaattagttgtacaaatcagatatgttataaaagaaacatctttcctattattgaattacccaaagttgcttacctaacatagaatcttgtggaggaaaataggccagtgaaattcagtgattattcattatgatcaaggtgattagtacagaaatctccatgactattctgtgcagtgtcttttctttaacaatattttataatcattcttatttttactttctgtagacaaatcctttcttgttttgcctccttttaggtacttttgagattataaaagtatatagtaaaaacaaatgcacacacaaaactattcggttggtatacttaattttgttagaatagatttagtccaggtatattccagtggtttcttactgagagtccatcctagtcccctgattattacttgagtgttcactgatggtttttccttcttgttaacaggaaatagttttggtttctgctaaaaatggcagttgccaccattctgctaaaaatggcagttgtgtgagttttatttcttagaaaataactatattttatatttggtgaatatcttagttttgcatttaatttgctaagcagaatcaatgcaatcactatcatattctatagtttttcctaacagattgatagagtaaaatgtatggtttttctaatttttagcatttgtgtccaataaaatgactttatataatttttttcttgttggttcattttttttccggtcaaagtttcttctttagtttctcatataattgattcaaaactcctaagtgatgatcacagtaaccttaggtatttcttatttctccataataaatatagcatctgagtctaatttcttctgggagatttattaacttttaagatagcatgtgtcacttacataatctaacaatgcattttgcatactaaaatgatgaaacattcttaatgaatttaaatagctactttatcagaaacaggagtcataggttgaatttttatgtgggtagtagagctaagaatatttgtaaaacagctctccatgatgggctccaacaggatgaagtaagaccacc

SEQ ID NO: 264432 - DNA, 196 bp, Homo sapiens
cccacggcccgccacacctggggaggaagggaagaaaaccacacctgctcagtgcgaatggaatgggttttgaagcttaatggtgcacggaatttctgtgtctttttgctgtctctgcatctgatgatcggtatctgtcttggatttgttttgttttgttttgttttttaccattcaataaacctcttaacataaa

SEQ ID NO: 264433 - DNA, 963 bp, Homo sapiens
catagacctagctctctcctcctatctttaccttacacatatactttcttcctggaaagtctgtcctttcacctctagtaaattccttatagtacaccattgtattcccagtgccaagaacagtgtctggaacatggtagactctcagtaaatatttgttgaatgaggaatgaatgaacaagcacacagttgagtgaaagaaatcacaaaattggctttatagtcccaactctccattttcttgagagaccctgagtaagatacttaacttctcagggcttcagtatacttaactggaagacaaaaaagactgggttgtaagttcctgccaactctaaaataataccattctataatgtagttaattcatggactgttgaacctctaagcaaaagtttctctgaggaacctaatcatattttgcaaggtaatatacatcctaataaagactgaagatgtaagagtctgtactgatgagacacttgcattcagttttagcttcaaaggaaatgtatgttttgttagcaagattaagactaaagattaagatttaaaatccctacattaattagaggggaaaaaagtgcatggaggagaaagaattttaagaaacaaataattaacaatactgtattgtatacttgaaatttgctaagagggtacattttaagtgttcttatcacaagaaaaaagaaaaaaatgctatgtaaggtgatggatatgttaattagcttgattatgatattatttcacaacatatacatacatcagaatatcaacttgaggccggcacagtggctcacacctgttgtaatcccaacactttgggaggctgaggcaggaggatcatttgagcccaggagtttgagaccagcctgggcaacatagggagaccctgtctctacaaaaaaaaataaaaatcaaattgtataccttaaataatatatataattcctatttgtc

SEQ ID NO: 264434 - DNA, 430 bp, Homo sapiens
cacataatccccaggagagccctccgacactgagatctgaaaagccctggctgggacactgcagactgacagtgcggtagaaacaaagagcttttctggtttactttcagctcaataaccacgacaccccagagccccagcattccagtcagctgcggcttcactctgtgtacactgcacactaaatcaggactacaggaactatcctaagccaagaatggccagccccacaatcgcttcaaaggcaggccccacacaagcgtgcacaccacacccaaggggctgggagcacaaagctcaaccaacagcctgaggccctgcttccaaacgctttcttatttcctgtttctaaaataggctaaagcttctcctcctgactctaaaatgtatgctttaaaagttttttagacaaaaccataagaaataaaac

SEQ ID NO: 264435 - DNA, 347 bp, Homo sapiens
ttatttttttcccgcaaaacaaggggctctagaattacaatttacatccaggttagagaagttgcgggaaggtctagcatcactcagttagcttggactaggtttaaaacttcatcagtgcttttggcacactcagggagcttctgccgtctttcaggcagctgtccgtcttcgagcccagcactgtgttgttgctttactgctattcccaaagccaagcttgtggagttcttagtcctcagatgaacacaattaagaataggactttgggaggccgaggcgggcggatcacgaggtcaggagatcgagaccatcccagctaaaacggtgaaaccccgtctctacta

SEQ ID NO: 264436 - DNA, 511 bp, Homo sapiens
tctggatggattaaagaaaccacagggatttctgctcttgtgtagttgtgtatttctgctttttactgctgatcccttgaatactcaccagattgaaaagctgtggcgaatgaaacatttatgagagtcagttattctttagaaaggtgtagaaccaaagcatttgccttggaatgtttgttaggaaattactgcttcttaggaatgctaaattagttctgttatctttctgtggtgaacttgataaatggctcaatatgtgcagcatagaataacatagtcgtatctggttattgagtcattcatttattttctctgtgagctcacagtacttgcacacctgccacatgcctggtgttgttgtaggtactagggcagcagtaaggaacaaaacatagaatcctgcttgcatggagctcacattatgatggggcaacaatgaacaaacaagtaagtaaaacttatgaattgtcagttggtgataagtgctttggaaaagaaaaaaaaacaa

SEQ ID NO: 264437 - DNA, 900 bp, Homo sapiens
actgctgggctacatggcccaaggctcctgggcgcaatggatcggtggtcttggattcgcctcagacatttaatgacatttgttcttgggctttcacaagtggtctctggttgagatggaaggaaaggacgcagggacacaaaatctctgactgcccagggaccacctcaccgtcctcacttccactcaagacgacatggccgttccactaaattcccgaggacatggccaacatgagtaacaacacagggaagtgccttacacagagttccatggaagcccggctagtaccctctagaccatttacctacacctgttgggatctctctagcatgaaatgctccagaggcagtcatgccataagcttggatcctccagccattgagtgtgagggtcttagcccggtctaaatgagcactgaattctagagagaccaagggaccgtctaagttctgaattctgagtcctgaatcctggaagttggcttctggccagggagcaggtgttactgcctctgatccacaaaagcagccccacagctcaagttgctcttctggatttctcccctctcctggttcctggccaggcaaatcttcactgctttgttagcccatccatttgctcaaccagatttttcaaatatgtatgttttcctccttttcccattgtactcagtggaaggaatggtctaaattacctaatcagcaattcctggaaaccaagccaccatgtacatacaatcttatacgttaatgtcacatacaagaaagaaaatgcagaggtaccagtagtggctacctaagcagtgtaatgtagaggtaataaaaacgaattgttggatagtatctatctatgccatgagtaaaatacatatcaataaattacaacttctaagaaaat

SEQ ID NO: 264438 - DNA, 532 bp, Homo sapiens
caaaagccaaaagcaatggaggtcaagctgcccggtacatgtttctttacgcctgacctcctgatggactcactagataaaatgctccttcttgtagccagcaagcaaatgagtacttttttatggcttacatctgtgcctggtcggccatcaagtctgggtgccactgtttgagatttggggctgtttcctgcaactgatctctgctacagataaggcttccctcctgaggccaaagccctggttaacgttaagagctctatgatgatgcaaacttcagaggcgatcacctaacataacaaaaacctccccagaaccagaacctgttttttcaccaaaacccttccgctgcttgaataagaatgtcttttcctttcctacaatttgtgccatggaaatgtgaataatttttcttagcggggtaaatcatagtggttacttgaatgccaaaaagatgctggaggggcaggtggatatgttgaaaagatatagaaagctttgtaaattgcttttgaataaatatgtgactagt

SEQ ID NO: 264439 - DNA, 501 bp, Homo sapiens
tgcaagacagatgattggattttagtgtaacaaagtatgaaaagttcattgatatcatttcagattctgtgttgcaactaatctttaagaaatgacaatttgttgaatttagtgtagcatcaaagaagaatatctacaattatgtgggagaaaaagaaactagtaaaatactctcccttttttgatggagatctccctggatctccgtcagccttgattttctttgtatacttaaaccaaaatgacatatcacaacagattggatatagaagcagatgaaaatctgtcttacattaagccacatattaaagagatttataaaactataaaacaatggctttcttctcaattcttttggaaagtaaagttttttttttctttttttttcaggaacataattatgttaacatataatgcaccttgtttttaaatgaaacagtgaaattttaaagtttttttcactttttatttctgattagatattatatatatcatatatat

SEQ ID NO: 264440 - DNA, 472 bp, Homo sapiens
caggcatataagggatgagaaattacttaatgagtacaatgtagactaatcaggtaatggttacattaaaagcccaggcttcaccgctatgcaatatactcatgtaacaaaactgcacttaaaccccttaaatttatacaaacttttttaaaagcaagaaaaagaaaacaccctttggggacatcaatatttttccagagcattaagttcttgagtgttaagttcttaaatgttaagatcttaaggccaaaacgtttaaaataattgatttatgatatctaaagaatttgaagtataaccacaaaactgttctgtttataaaatatgagaatagtaaaagtattaagcccagagttaggtaagcaatgtcacgttaagaagagagggggcaggcacattctaaaaattgtacatcaatatacttaatattaatcctcagggcaaaaggttagagaacagattcagcagaaag

SEQ ID NO: 264441 - DNA, 618 bp, Homo sapiens
gtctgactgccaaattgattccttttttgctatgccatgctgcctttaattcatagtgattgttacttcaaaatcaatcttgctgcagtatatatggactggactagctccgtcatgctctttcagcttgctatttacccgtattactttcactaggtactgtctagaaggggtccagtagaaccagaagagttttctcagagaggaagcaacattttacaactgaatctacactacatatacagaagagtccaaagttggaaacctaagcaatccaagaaatcgctgtccctacagaagttaaacaataggatactttctctcctgctttaataaatggttgttatcttgctctgaagataattgaagcagtggacatctcatatccttttctacttattgggctagagtcagagtcaccctgactctgacttattttttaattgataagctcttcaagtcagagagaacttggtgcaactccaggctctcctaattatttatggaaataaataaatatggacaagtccattactaagtctgtaaaatcgagaaaatatgataaaccatgcatgattatattgagtatttaataaaggatctttggtaccaggcact

SEQ ID NO: 264442 - DNA, 495 bp, Homo sapiens
cacgaggtgctaaaggtctgtgtttggtatcttactgtctcatctcccattaactcctcagtgcactgcattctggcttattctacctctactccagcttagatcaccaatggcactgcaattatccatcctcagccttctctccttcagtagcatttatatgcactctatgttggacacagttccacacacacccatggatatacttagtcaactctacacaagttttccacaaatccttcatatgcaacatgtctaacctacccctgcacacccctcctcagcccatctccccaacctcagttgtctaactagatgcctgggggtgtgcttgattctttccctttcctagacccctaatctaacaggtcaggtcaacaagtccttgactcctactacagactcttgaagttgtcttccttccagtctgtcactgccgccttagttctggctgtcttcatctctgtcttgaactgtaggcctctaaccagtctc

SEQ ID NO: 264443 - DNA, 452 bp, Homo sapiens
tcctttcccgagtcagtactgctttctagaagaaaaccggggagatctatttggaatgtatctaactccaaagaaaccatcagaggtaacagtagagacggggtttcaccatgttggccagactggtcttgaactcccgacctcgtgattcgcccgcctcggcctcccaaagtgctgggattacaggtgtgagacaccacgcccggcggatagagagaattttgacaggatgattacggagctaggaatttcctacgaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaatagatctctgtgg

SEQ ID NO: 264444 - DNA, 366 bp, Homo sapiens
tcctttcccgagtcagtactgctttctagaagaaaaccggggagatctatttggaatgtatctaactccaaagaaaccatcagaggtaacagtagagacggggtttcaccatgttggccagactggtcttgaactcccgacctcgtgattcgcccgcctcggcctcccaaagtgctgggattacaggtgtgagacaccacgcccggcggatagagagaattttgacagtctctccaatgaacgccttcactgatatccaaagcatgaaggacacaccagggaaaaacatagacctaacacaggacaaatggaattattagaaacattttctagcagaagaacactattctgttgccatttgaatct

SEQ ID NO: 264445 - DNA, 690 bp, Homo sapiens
tcctttcccgagtcagtactgctttctagaagaaaaccggggagatctatttggaatgtatctaactccaaagaaaccatcagaggtaacagtagagacggggtttcaccatgttggccagactggtcttgaactcccgacctcgtgattcgcccgcctcggcctcccaaagtgctgggattacaggtgtgagacaccacgcccggcggatagagagaattttgacaggtgaggaggtattccaatgcaaaagaataataggagcaaaagcacagtggtgagaaattggaggggaactgtgaaaattgccacatagattagaggcaggaaaataaaggacagctaagtttatatagtgaacagtgagccgcatggacacaggtgactgttttctcctttttgaacccctgcttactccagagtcaccacctctcctggctttctgccaatcttcttggccacagtttctcggtcttcttttctggcttctcttccttggcctgaatgctacatgttaagtgatgtcagcttcagttttcttaacctctcttctcttaagttgctatcatttaaatatctttaaatatcatctacatccaagtgacctctaaaccagtaattttacccatgacccatctcctcaactccggattgtatataaaactgtctactcaacatcttcacttttga

SEQ ID NO: 264446 - DNA, 291 bp, Homo sapiens
ctcctgctcgttttttttttcttccaaaatcaggtgcacaggggaaggaagtttcagcctagtactcagatatgaaactggctgatctgaaataaaagtgagggcattgaatagcgtggataatgacaatctggtttacagatatggttgatttcaaacaatgctttccacatgaaagaaaaacagcaatgtgtcacagagcttgccttgccttctccagagcactttgtaaaggagagagctgaagtttaaaataacatcattttctctagaatgctcttcttgttttat

SEQ ID NO: 264447 - DNA, 650 bp, Homo sapiens
gcccggctaatttttgtatttttagtatagacggggtttctccatgttggccaggctggtctcgaactcctgacctcaggtaatccacccacctcggcctctcaaagtgctgagattgcaggcgtcagccaccacgcctggccgtgaccatcttatttttttaaagagagagttcagtactggttctgagatcaaaagcagccagatccctggtatcacagaagcttcatcacggattcatctatttttcatctccagaatggccacctcagtgctgtcctggccaaaaatctgttctctagacctggagaaggaactgccctgagggtcttccacacctctctttttgagaaaagttaagaacaaagtaaaaagatgcagtggagaaatgacgtcgggggttaatggattgggattttagggctggagtccaggcttacagagacggaaatgtgaaaaacagtcaagtagagccattgatatttgctgaaaaattctatgtgacaggtgagaaaaaaggggacaatcaaagttttagctaaatcagtgagaaggatggagttgttttttctttgtgattgtgaagactgaaagtaaagcaggtttggggaaaataatgacttgttttgaacatgttaactttggtcgac

SEQ ID NO: 264448 - DNA, 1070 bp, Homo sapiens
gccaggtgtgcaggccgctccaagcccagcctgccccgctgccgccaccatgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacataaagctatattaaaaatgtattgttgaatc

SEQ ID NO: 264449 - DNA, 455 bp, Homo sapiens
tatctgctaatcccactagagcaagttcctttaaggctgataccaggtcttactcctctatttatctcaactttattaatttggtaatgttaagtcttagcacatttagagaattggcttttaagtggcacatatccatatactaacccatgccatatgctaaactaatctacacgtgataggcaacactcatactatgtgctctgatggctgctatgctgacctctttcaccaatggctgccacttgtcacactgtgtctcctcatgagggaggaggtgtcctatctgcagtcattatttatacatggcttgaagatttgcaagatcgtaattttttaaaaataccacttcattctgattatgaaagcaaaatctactcattgtagaaaatatgaaaaactctagtgtacaaaaaggatattaaaaactacctgtgatttaacctactgtcatt

SEQ ID NO: 264450 - DNA, 564 bp, Homo sapiens
agataataagatgcaagtaaaggacttggaacagagtctggcacctggtaagttgttaacgtcattgccctttgattgtccagtctgccctttcacagaactcagcgtgtttgggtttcctttcctaagatgcagcagctgccagtaaagtccattcaccccagaataagggtctggtaaatgaactatttgcagaaagccaggccttgcagggtgctttcaatgggcaagaggacacgatgacaggtgccgacgaggtattcctctccacttcctgggaaagagggcaagcctgtaacaggtgcagtcatgggggccccagtaggggatggctgagaggatgaagcttccattttcagagtttggatgaaaacaatcagagccccttttccagtggaacttgtaactgcttactcatcacaaataacttaaagcatgtcatcaccattcctggctgcaggaatgaatcctgcccagagaggagatctgttttcttccttaaagccctaagagtgttctgcttcaattccctgtgtgggacatagatatattaaatacaaaaaa

SEQ ID NO: 264451 - DNA, 559 bp, Homo sapiens
agataataagatgcaagtaaaggacttggaacagagtctggcacctggtaagttgttaacgtcattgccctttgattgtccagtctgccctttcacagaactcagcgtgtttgggtttcctttcctaagatgcagcagctgccagtaaagtccattcaccccagaataagggtctggtaaatgaactatttgcagaaagccaggccttgcagggtgtcctcaagacgcacgcgtcctccagaccccctcccgtcgtgtgtcccttgtaaatagaatcagcccgggcggtatcctgttccattccctggcctccgggtgtcaatagagtgtgataatgatgttgataaagaaaacgtcggattgcacctgccaacatggcgccccccctcctacatgtataactcccctcctgtcctatgccaacaaagtttactccttcctcaccccaccctggaggcccaggtgagtcgtgcgcgctcctgatatcttagtttccccagtaagccttgcgtgtgtactgacccccgttcatttatgtgatggcgtgaaaacctgaaca

SEQ ID NO: 264452 - DNA, 557 bp, Homo sapiens
agataataagatgcaagtaaaggacttggaacagagtctggcacctggtaagttgttaacgtcattgccctttgattgtccagtctgccctttcacagaactcagcgtgtttgggtttcctttcctaagatgcagcagctgccagtaaagtccattcaccccagaataagggtctggtaaatgcacctatccatccaaccatccggtacaggcagctgtcgatccgctatatgagccgaggacaggagccccagccataatcattcagtattagtaggagagatggtcagagaggcacaagtgcagtagtaaatgtcccagtatggtatcctcgaaatgaataagcagcattttggacagtaggagtccgtgcaatatgaggccgttgtgaactgcgcatagtttgcgtgttctgatgaccaacagcttagagcaggtaaaggccgttcaaggctcccgtaatagatccagcgcacagatgaagtctgatttgttccttcaacccaagatagtgttcttgttcggtccggtgtggggcagcttcattaattgtatgc

SEQ ID NO: 264453 - DNA, 929 bp, Homo sapiens
gaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccacaa

SEQ ID NO: 264454 - DNA, 2767 bp, Homo sapiens
gaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctggggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccacaa

SEQ ID NO: 264455 - DNA, 505 bp, Homo sapiens
acttttttctggtcctctgctacaggatgtgctgggctttcagaagaagggagcaaaaggtcaccatctctcttgtttattcaaggcctggtgctcattctctatgagacccttccaatgtctaacatgagtctttcatagtaggactaaacctctttgaaaactattgtatagtcaagatagaaaggaggttagagctctgttgactgtttttaccactcctggaagaattgaactcggggcatgtccaagtcacaagctctttttttaggaattgttttacatgagcatttaaaaaaaaatagtaggacaccccaaatacacacacccccccaccctggaatttacaaacgctaaccaaacaaaagggtctttccattgactgcctggatattagtgtaaatactaggatgttgctttgcaagtatattttggagagcgagtcagttacctatgatgagatttctgcaaagcagccgttttaaagcagcatgcttgagtgacc

SEQ ID NO: 264456 - DNA, 426 bp, Homo sapiens
aaaggatggtagagctttcatattataccatgtgaggaaaagaaggaaggaaaagaggttgagtgtacaagccttagaatgtagtgcagttctaaaaatgtttgtcaagactggtagggaatcatcacatcaaggttgcctgccagaggaattccacatctaggaacagagctacctcagtgtccttccaagctaattcactgcctgggagatacatgtgaaaagattggctttagtatacatttggtaaggaagttcaatgggcaaaatctggggtgaagatttgaaaaaaacattttcataaaagataacacaaaagaataaagaaaatggtagtgtgatggttaattttatgtgtcataaaagataaatataaattctatctatctatctatctatctatctatctatctatctatctatcct

SEQ ID NO: 264457 - DNA, 468 bp, Homo sapiens
gtgacatttcttggtgtctcctgaggagccgccccctcgtcagccttgctcagctcttcatctctctggtcgctatcaccggggacatgccgtccccagctcagtgacaaaaatgctgagtttcttccgtagaacactagggagtcggtctatgggtaaacatgcagagaaggaacgactccgagaagcacaatgcgctgccacacatattcctgcccctggagattccaggtccatcatcacgtgtcaggtgtcccttctggatggtactgatgttagtgtggacttgccaaaaaaagccaaagggcaagagttgtttgatcagattatgtatcacctggatcttattgaaagtggctattttgatctgagatttatggattcagcacaagtagcatcaccaaagtaattcaatggaagaagaatagtcttaataatggtgctggattagaacctgtggaaaaaggc

SEQ ID NO: 264458 - DNA, 563 bp, Homo sapiens
atccacccccttccttttttcttgcttttctgaatgggtcttggagatttttcaatgtaagatctagagaccatccatattgtttactgttggttgataattttatggtattccattgtatgaagatactggtctttacttaatcagtcctgtattggtggaacttagtggacatttgttttgtttgttttttgcattaagaaaagctcctggcaggtttcagagacttaaatgacagctaaaaatctggtgggattacaggtttcagaagtgacaaggtttaaaatagatgaaattgttgggggagccctagcctcccttcctgcacaccctcttcaggtatctaggactcgaagtcttatcaaaacaggacacttattacctgctagtcacaacctatctatatgaacatatacattggcgtgggaagtttgtctgtgattgtgaaacaagattgtcttgctaaagacattctgaatatgtgaaggcaggagggagagataattgtaaggctttgagtgcctctaaaatcctactggatagttgttggcttcaaaaaaagg

SEQ ID NO: 264459 - DNA, 223 bp, Homo sapiens
tggatggatccccgactggccaggggatcacaggcagtgaatcctctccctcacctgtccccatacacagtcttggcttttgtagttatagccaccttttcctacacattgaggctgttcctctcccatctttgccattggatctctacttgctttgaaattgttactgtcactgggtccattgcttgctccaaatacctgtttgtttgtttttaagacatga

SEQ ID NO: 264460 - DNA, 430 bp, Homo sapiens
attaaagagtacaggaaaatggcagccctctgctggtggtgtaatagtagactgaaagccagctaagtcaaaccacacatgtggcagagaatgcttctcctaacatcactcacagatctactgaaactcacaatgcatgcctacacctcaacttcaaacaatagacagagatttaaaagaacacctgaagggagacaggaagagaaacagaatatgaagaggattcaaccaaacagagccaatgaagcagacagagcaacttaaataataagagcaattttttaaaatgagacaaaaaggaaaggatactcagtgcatagttggtagcttaagaaaacaagaatttcttaaatcatagagcaaaaatgcaaaagaatagaaatcatgagcatcttaggatagattaatcaatgctatgaggtacagaagg

SEQ ID NO: 264461 - DNA, 448 bp, Homo sapiens
atggcagtctcctcctcagattccaaaagatacacggggcacttgagctcagccttgagagcctctgatgactgtcctggagaggttctcaaccacaatcttggcagccggtggaggcaggtggtggtcccaatctactaccaaccccaagtcttcaaagtccatcctattcaaaagtgaccttacgagctccagcaccatgttggttcgagtctcctgcttgagggtccaacggctcacagtcgtgttcatcgatataggacgccatggctgcccagccgtctgacatgtgatgttttgatacaggtatacaatgtgtaactatcaaatccgagtaactggggtattgatcatcttgagaatttatcatttctttgtgttaggaacagtccaattccactcttttagttattttaaaatatgcaataaattattaactgtagtcact

SEQ ID NO: 264462 - DNA, 419 bp, Homo sapiens
ctggttctgtttggttttataggtgtggaaagagggatgtgaaattttcctagactaaatgcacaaaagtttaggctagacatactttcccactgttttataactccttgtaaattttctatgtattgtaaatccatattttatttaaatggaaattcattgcttgaaaaaccaattgtgtaaaaactattggctatgaagtattttcaagtatcttcaaggaatccattataaaggtttgatttgataaagctttattactatatggcaatagactaatggagacaagcataagaacacaaacgacatcatgcaagatataaagcacgcacttcaaattgtatttattgtatgtgtttaaaagtgtgttgcctaataaactcaggagaaaaataaatatatccttgaatatgctgaga

SEQ ID NO: 264463 - DNA, 394 bp, Homo sapiens
ccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaagagaatgggaacaattctcctttgcccaaatatg

SEQ ID NO: 264464 - DNA, 817 bp, Homo sapiens
ccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaaggtacagtgctggaggaatgtgctactagatgataatggaatacctcctcttgtatcattcattctattcattttctagcagaacacacacactcgaggctactcagttaatgtgttcaaagcctaggttttcaatttggagtgtaaacaggtttgactgtcatgctcagttgatggtctagttgggcaagtttatgagcttttgttagtttgtagctctttttttgcacttgttaatacaacttccttattggtgagaaacattctttttggaataaatgagatgagcacttgctctgaaaagcactttggtctctgtcacctgatagtcatgattttattaccttaatgctttttaaatcaatacaaagccttcaagttagtgttttttaggatctgtacttgtgacattttaaacaaggattaaacagatttatatcaatgcaggatgagtgtt

SEQ ID NO: 264465 - DNA, 6475 bp, Homo sapiens
  misc_feature (4)..(4): n is a, c, g, or t
  misc_feature (8)..(8): n is a, c, g, or t
  misc_feature (25)..(25): n is a, c, g, or t
  misc_feature (37)..(37): n is a, c, g, or t
  misc_feature (40)..(40): n is a, c, g, or t
  misc_feature (52)..(52): n is a, c, g, or t
  misc_feature (64)..(64): n is a, c, g, or t
  misc_feature (75)..(75): n is a, c, g, or t
  misc_feature (514)..(514): n is a, c, g, or t
  misc_feature (1220)..(1220): n is a, c, g, or t
  misc_feature (1286)..(1286): n is a, c, g, or t
  misc_feature (3600)..(3600): n is a, c, g, or t
  misc_feature (5647)..(5647): n is a, c, g, or t
  misc_feature (5715)..(5716): n is a, c, g, or t
  misc_feature (5719)..(5719): n is a, c, g, or t
  misc_feature (5769)..(5769): n is a, c, g, or t
  misc_feature (5772)..(5772): n is a, c, g, or t
  misc_feature (5787)..(5787): n is a, c, g, or t
  misc_feature (5795)..(5795): n is a, c, g, or t
  misc_feature (5811)..(5811): n is a, c, g, or t
  misc_feature (5861)..(5861): n is a, c, g, or t
  misc_feature (5868)..(5868): n is a, c, g, or t
  misc_feature (6437)..(6437): n is a, c, g, or t
  misc_feature (6460)..(6460): n is a, c, g, or t
gtgntgangatggtggtggttgtgntgatggtgatgntgntggtgatgatgntggtggtggtgntgatggtggtngtgatggtgatgatggtggtgatggtggtgatgatgatggtgatcatgatgatggtgatggtggttatggtggtgatgatggtgatgatgatggtgatggtggtggtgatggtgatgatgatgatagtgatgatggtggtgatgatgccaatgatgatggcggtggctgtcatgccttgctaacctctgggaaagattgaggacatcggcatgtcggaaaggggcccagctccagttcctcagagtacatgccttgaatacttgggcatggaatctccccaaacttcccttttcccacctgcaaaatggaaataatatctgtatcagctataaaggcttatgcaaatattagtggttttattataattcagaggactaccctggagtttaatcctctgagtaaaaagcaggaagtaaaaactgtagcagtttgtaaacngtctgtgatgttagattgtttccatttaacattttatgtgattggtgtttagacatttctcttcatctgcattggtttttcttagggtagattttcaaacttatgtcttttaaaatacttttaaaaaatacaaaaagtacagaagatgatgtgctaagcctccctcgcctgccctttggtgtggtgtttgcgacggcccagggcccagctcttccaggcttgtctgctgatgcccacagggacccctccctgcagtctttgttccggtttcctcagggcctttgccactagtgggggttcatgctgaagcctctgcctgaggtagtgagttcccctgggccaagtggctagggacagctggacctccctaagagccaccagcggcagcaaacatgccaacatgtctgcaggtcaatgggtgagaagcaagaggagcccaactcgctttcccgttttaggtcattcactagatttcccccggttttgccttttttttttgagacagagtctcgctctgtcgcccaggctggagtgcagtggcatgatctcggctcactgtaacctccgcctcctgggttcaagcaattctcctgcttcagcttcctgagtagctgggattacaggcgcctgccaccatgcccggctaatttttgaatttttagtggagacagggttggtccggctggtctcaaactcctaacctgangtgattctcccacctcggtctcccaaagtgctgggattacaggcatgagccaccgcgcccggcccnttgcatacatcttggtccaaatcagattctgtcttggggagcatcatttcataatcctgctggctttgaacttgtcacagttcagacgtcttccttcttctggctcctcctggtagccccaggtgcctccttcctgacagagcctgctgctcccgtaatacacactcacccctaatgagctacttaaaaataatcaatgatttccagataaaaatcaccattaattttaaatgccctctgtaaaccttgttacaaataattgccagaaacacacaaagtctgaaattaattaaaatcgacagcctcatttgacgggagttgagcttctggcttcttggttatgtgcgtctcttgcttgggcagaagcagtggctgcgagatgtgagcccatgggggagtttgcttaggacccgccgagcacttgggcctgtggaggagtggggaggacacgggcttagagtcctgcagacttggctggctggcctgtgccctcttagggtaatcggatgactttccgagccccaggtttctcatctgtggaagggtttggtagtgccagctccccagggttgcacgtaggtgatggcaagggtgtgcctgccccaagtggatgctcagtcatgatcttgtcgtctttcctcttctctctccctgccccagatcagcctttgcaaagtactcatactgggtcattcactcactcattcactcctgcagtgagatacacagaagctgataggcagcagaggcggcagggacaccgggttcccctcatctgaaaaaaaaacactgaggctgagaatggagaagtgacttagtctgggccagtcctggcagaaccaggagagaacctgtgtgccatgaccccctagcccagcgctgtttccaccgccacatccccgttccctcggggctggtgggtgatggggaaaccgcatttgccaaggcaacgggaggcagccgagggctggggctgggaagtcctgcaaccccctggccctagggtggcacgagcccctttctcagcagtggggtacgtgtgcaggcaccagccagttcttcagctgggttgccatagtaactggatacacttttgttaccttcttttcatggtcaaccttttgtcagtttccattccagaactctgagagtcatcccagcgtgtccttgagcagaacacctgcgtgccgctgtagcttgtcacatttctttgttggtccccgtgtagctgttgttaaggggcacagaaaagccagtgtcccctccctcccctcctttctgagagagcacaggtgaagggcttgtccagccaggaacgaattctcaggtccactcttcactgatgcacaaatgctaggcagtcacttagcatctctgagtcttggtttcctcatctgcagaatcaggaaagtcacatttccctgatcattagcctgttcattgagccagggcttcctgagcacctgctgcctgccaggccttgggtgaggtgctgggttcatgacagcacagggtccccaccttcaagaccatagccagatctgcagacagatcagtaaactccaacttggtgagtgaggcggggagtgcagaggtctgagggggtcacgagaaggagctaccagcccagccaggggctgctggagacagtatccgaggagggtagagatgacacagggaaagtgttgaacagatcatgccgctcagttagggcagtttcttgcctcctcctccctctccctcccagtctctaggtctctcctctcctcccctctgtctccctctttctccaacctgatgggaagctttggacataaaggccgtttcctcatcagacttcttctatgcctttggtcccagagacacggcaacccccacgccctaccctaagtctctgcagacagcagctccggagaagagaacaaagcttgggacttatttatttcccgttttgcagaaatgtttatttgaaagcagcacagcaaggtggaatggtttgatttgattagcaagtctaaatgtattagcagcaagacagaaacgatattacaattagcagtaattagctgtgtgatgactctgggcggcagtgctgggtgacagatgctgcttcctggtcccgggttagacggagagggcatgttacccttgtgaaggggctcggcttcctggggcgggcagaggaccctggccttgttttcaaggctgagtgacagctaattgtcccttggaagagacacaggtgtcagcacccacttgtgttgtgtggaaagtgactttgcggtcttgggggaggcagtggcttgacttgtanggatttggaagcttcgcagctgccctgaatttgcctctgatggcagtggcttccttcgtaccactcatcccttttccaatctttatcacacacagctcctccagacccccttcactgggttttacttatgggctggctctgtccctgagatgtggcctgtgctgcatccctgggcctccaaggtctgcagtgtggacgccctgtgtggtgatgcccggtaaccctgcagggtgctggacatacactcaggagactctgggaaccgtgtgtccacatcgctacatgttacctacttcagcgtgggtgagcagtgactgcaagccagtctgaggtgtagatagagacacctgagaccctgaacctgtcctccaggagtccagatcttccactgggggccagacatgctgacatcctgcagaaagaaaccagtgctccttttggagtggtgaaaatgtcctggaacttggcaggggtggtggttgcacagcttcgcaaatggagtaaatgcagtggcctcgtaggctttgaaatggttacttcttctttccttttttttttttttttttttttttttgagacgaagtcttgctctgttgcccaggctggagtgcagtggcgtgatcttagctcactgtagcctctgtctcccgggttcaagcgattctcctgcctcagcctcccgagtagctgggactacaggcacccgccatgatgcctggctaaattttgaatttttagtagagaccgggtttcaccatgtcggccagactggtcttgaactcctgacctcaaatgatccccctgcctcagcctcccaaagtgctaggattacagaagtgaaatggttacttttatattatgtcaatggttttacctcaatgaacaaaaacaagcaagacaacaagacattttgaaagcccaaacaccataaactgggcacagcttaaagtgtctgagcacacacagccggtaaatggagatagtcatggacaccaagtctccctctgagcagggaaggagctggaggagccaagaggggagaggcacagctgccacggcgctgggcacgtcacaggccagagttggagaaggctggggaggacactgggcagacatgagacaacctttcctttctgccactggctgccctccaggggctgcaggaaggggtcagggtctgccttcctatggctgggagggggctggcagtcctgcagccccgcctgtccttaagactgcctcctgagtgcccttgcacgacctcgggtgcctgtcagagaccacgacagcctctggagtgttggctgctctttccctggtgtcacacgtgaacttggccttggccactgtgttcatcaggccgccaataccaaaggaccagggctgctcagagaggcagcccccagatggcacctcctccctgtaccccactgcccccaagccagcaggaggatcctccacactctagatctctgccaagcactgtgggtgcaggagagaatgaaccagatgtggtctacccttagggggctgcagctggagctgcctgagccacgtggcagcgaggtctaggggtgctggaaagggacaaagctggaagaaatgttttctgagcccaaagtgcagtttcattgcagggggtggttgttactgggggtgaggctgtgaactgggaagatgccctgtcctgcgttttctccccggggccagtgggcctgcctcacctgggatctccagatgcagcagctgcacgcagagtctacacagcagtggccacctggttcccctgtggacacatcctttgttcctcagaatgaaaccatcttgtcaacagccttcgcctatgggagccaggagattggttagctcctacgggagccaggagattgggcaggtgtagtagaagaggaaaaaagggcggtcattctacaattgggaggatgccttacccgaatcagagaaatgctgatgaaaaccacagggaggctgggcgtggtggctcacgcctgtaatcccagcactttgggagaccgaggcgggtggatcncttgaggtcaggagtttgagaccagcctgaccaacatggagaaaccctgtctctatgaaaatacaaannttngccaggtgtggtggcgcatgcttatagtcccagctacttaggaggttgangcnggagaatcgcttgancccgggangcggaggtggcagtgngcctagatcgcgccactgcactccagcctgggcatcgcagggagtctccntctcaanaaacaaacaaaacaaacaaaaacaaaatcacagggagagtcctttttgtttcttccagacgaataccaacactgaaggagaatgatgacggtgttgggggctcctgggtgtgaggagtgctgctgggtgggaagtgggagaatttggaaaacaattcggaaacatctagtaaagatgaggggagatgtacatctcctgcaaaccggagatcccacttgtaggtatttcccatagagaaattattacacacgtgtcctgggaggcctgaaaatcctagcagccaaaatgaaatacaacagaatgtggccaccactgatggataatggataaatatgcacatgtatgcactgtgtctacagcaaggaaaaggaatgagtgaggccacgtgcaacaaccttgactcttgggagcttggagttgaagttttcttcaaaaagttgcagaagaaaacttcatatgatttcatttaattaaagttcaaaacatgcaggccaggtgcagtggctcacacctgtaatcacacactttgggaggccatggtgggaggattacttgaggccaggagttcnagatcagcctgggcaacatggtnaaactccatctctac

SEQ ID NO: 264466 - DNA, 2305 bp, Homo sapiens
  misc_feature (4)..(4): n is a, c, g, or t
  misc_feature (8)..(8): n is a, c, g, or t
  misc_feature (25)..(25): n is a, c, g, or t
  misc_feature (37)..(37): n is a, c, g, or t
  misc_feature (40)..(40): n is a, c, g, or t
  misc_feature (52)..(52): n is a, c, g, or t
  misc_feature (64)..(64): n is a, c, g, or t
  misc_feature (75)..(75): n is a, c, g, or t
  misc_feature (514)..(514): n is a, c, g, or t
  misc_feature (1220)..(1220): n is a, c, g, or t
  misc_feature (1286)..(1286): n is a, c, g, or t
gtgntgangatggtggtggttgtgntgatggtgatgntgntggtgatgatgntggtggtggtgntgatggtggtngtgatggtgatgatggtggtgatggtggtgatgatgatggtgatcatgatgatggtgatggtggttatggtggtgatgatggtgatgatgatggtgatggtggtggtgatggtgatgatgatgatagtgatgatggtggtgatgatgccaatgatgatggcggtggctgtcatgccttgctaacctctgggaaagattgaggacatcggcatgtcggaaaggggcccagctccagttcctcagagtacatgccttgaatacttgggcatggaatctccccaaacttcccttttcccacctgcaaaatggaaataatatctgtatcagctataaaggcttatgcaaatattagtggttttattataattcagaggactaccctggagtttaatcctctgagtaaaaagcaggaagtaaaaactgtagcagtttgtaaacngtctgtgatgttagattgtttccatttaacattttatgtgattggtgtttagacatttctcttcatctgcattggtttttcttagggtagattttcaaacttatgtcttttaaaatacttttaaaaaatacaaaaagtacagaagatgatgtgctaagcctccctcgcctgccctttggtgtggtgtttgcgacggcccagggcccagctcttccaggcttgtctgctgatgcccacagggacccctccctgcagtctttgttccggtttcctcagggcctttgccactagtgggggttcatgctgaagcctctgcctgaggtagtgagttcccctgggccaagtggctagggacagctggacctccctaagagccaccagcggcagcaaacatgccaacatgtctgcaggtcaatgggtgagaagcaagaggagcccaactcgctttcccgttttaggtcattcactagatttcccccggttttgccttttttttttgagacagagtctcgctctgtcgcccaggctggagtgcagtggcatgatctcggctcactgtaacctccgcctcctgggttcaagcaattctcctgcttcagcttcctgagtagctgggattacaggcgcctgccaccatgcccggctaatttttgaatttttagtggagacagggttggtccggctggtctcaaactcctaacctgangtgattctcccacctcggtctcccaaagtgctgggattacaggcatgagccaccgcgcccggcccnttgcatacatcttggtccaaatcagattctgtcttggggagcatcatttcataatcctgctggctttgaacttgtcacagttcagacgtcttccttcttctggctcctcctggtagccccaggtgcctccttcctgacagagcctgctgctcccgtaatacacactcacccctaatgagctacttaaaaataatcaatgatttccagataaaaatcaccattaattttaaatgccctctgtaaaccttgttacaaataattgccagaaacacacaaagtctgaaattaattaaaatcgacagcctcatttgacgggagttgagcttctggcttcttggttatgtgcgtctcttgcttgggcagaagcagtggctgcgagatgtgagcccatgggggagtttgcttaggacccgccgagcacttgggcctgtggaggagtggggaggacacgggcttagagtcctgcagacttggctggctggcctgtgccctcttagggtaatcggatgactttccgagccccaggtttctcatctgtggaagggtttggtagtgccagctccccagggttgcacgtaggtgatggcaagggtgtgcctgccccaagtggatgctcagtcatgatcttgtcgtctttcctcttctctctccctgccccagatcagcctttgcaaagtactcatactgggtcattcactcactcattcactcctgcagtgagatacacagaagctgataggcagcagaggcggcagggacaccgggttcccctcatctgaaaaaaaaacactgaggctgagaatggagaagtgacttagtctgggccagtcctggcagaaccaggagagaacctgtgtgccatgaccccctagcccagcgctgtttccaccgccacatccccgttccctcggggctggtgggtgatggggaaaccgcatttgccaaggcaagccaagtgggaggacacaaccaagtgggaggacgcaaccaagtgggaggccaaccaagtgggaggccag

SEQ ID NO: 264467 - DNA, 278 bp, Homo sapiens
cagagttcaggccgggccagaccgggccagtccagagggagaagccgctactgcaggagacagagcgatttttccgctgcaaatccttgagaagggaggatggaggcggcgggacgacccagtgaagccggccccgaacgccaagtgagtgtgtgccgtgcgcgcgcgggtagctgccgaccgcaacgacataaacttgaaagtgaccgctgtcccggagctccctgctcccaagggacccgtcgcgttgcagagttgtccggtcgggcctctggggc

SEQ ID NO: 264468 - DNA, 361 bp, Homo sapiens
accctgaaaagttgcttagtgtcctttgtcttccactctgtcacttataacggaggcagcctggccacaccgtgctggaactcttcaaagctctcacagaaccagaccaaaggctttttctgttgaatagtgctatggtctaaatttctgtgtctccccaagctcataggttgaaatcctaacccctaggacaagaggtggggcctttgggaagtgattaggtcatgagtgggattagtgcccttataaaaaaggccaaagagatccttatcctttcccccatatgaggacacgtgagaaggtgctgcctatgaggaagcaagccttcatcaaacatggaatctgcaggcatcttgatctc

SEQ ID NO: 264469 - DNA, 372 bp, Homo sapiens
tcaccaacaaggccatgaaacccagagaagggatgtgacttgagatccagccagacccagatccagagttgggagggcaggggtgctgcaatatgatcacagaatcgacactcgacccctcccagcgacctggcaaagtgggcactaactccattctgcagaggtggaaactgaggccagtgtggggaatggaaattgactgggctaagcttagaagcctgaactctgaccccaaagctctctcttgtacctttgacccccttgtcttgtcctgcagctcttaaggttacagtgagccagtttttcattttgcctttctccaatggaggcaccttggaaaatagagatctggctggagcaacctggaaaaaa

SEQ ID NO: 264470 - DNA, 467 bp, Homo sapiens
tatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggtctgctaaaaaaat

SEQ ID NO: 264471 - DNA, 395 bp, Homo sapiens
tatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccactatgaactcaaagaaaaccaacgacgatccgacaccgacccattccgtc

SEQ ID NO: 264472 - DNA, 358 bp, Homo sapiens
tatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggtctgctaaaaaaat

SEQ ID NO: 264473 - DNA, 271 bp, Homo sapiens
acatgactctgagctactgagacgatcaagctgacttccccatgctatgactatgcatgtgtttatgggtacgtacatacacatctatctttatataaatcactaataagatgggcaagtgtctagcatgcagtagatgctaaaacaaatgttgaatctttgttactcagataggtacatggacatgaaactgcctcaaagaaatgtgttaaggcctaataatgtgaattcaaaacattcaagaaataaatattttcactttccctttttc

SEQ ID NO: 264474 - DNA, 425 bp, Homo sapiens
ataactaatgcttacgtttttcactacaaatatttccccattctgttgttttcctctttttcttagttttgtggtccatatttttctttctgatttttttattgcttcataactttaaaagttatccttcttccagagttgacattatgctttatcaaataattgcactgatgatttttaaattctatacttctacttgatttgatgttacctaaatttaactccttaaatcagctgagatacattgtgctgccttagtaggagataggtagaaaggtgaggataggaataacatctaccttacaccattgctgtgacaagtgaaagacgcaatgcatgcatgtctaacactgcgcctggcaggtaaagagcagggactcagtaagtgacgaaagctattaatttaattcttattatcagtatct

SEQ ID NO: 264475 - DNA, 351 bp, Homo sapiens
ccaaaaccaggccagtcacactgttgcctgctcacgtttctgtcactttggtcatggggaatttacctataaagggaaagggagacttctcttgctttgaccacaataaattgagtgtgtttgcgaggggcagagtggtggccgtggaagctagcgtgtgtttaggccctgtctggggcacgtggaggaacagctttctccttctcattggcatcaggattaaagagaagaaaatgggttgctgtcttttctacctacgcagcagaaggagcattcacaaatgagaatttccccagccccagcagggtgtctaaggagctactttgtagagtgtaatttcatgtagtatct

SEQ ID NO: 264476 - DNA, 363 bp, Homo sapiens
ccctacagtaactctcccattgagttcttaatagaggtgagttaggttttgcagatttctggctcctcgctctgcttagagaagccagaaagaggccgggcacggtggctgatgcctgaaatcccagcattttgggaggctgaggcaggtggatcacgaggttaggagttcaagaccagcctgaccaacatggtgaaactccgtctctactaaaaatacaaaaattagctgggtgtgatggtgcatgcctgtaattccagctgctcaggagactgaggcaggagaatcacttgaacccgggaggcggaggttgcagtaagccaagattgtgccattgcactccagcctaggcgacagtgagac

SEQ ID NO: 264477 - DNA, 427 bp, Homo sapiens
tgggggaaggtgcaggaatgtgaggctcaatactcacgggcttaccatgatgcacagagtgggggtagacaagacggcacttccaagccacagcgtctgccctcatgccctatccctacccttcaaagacagaagtgggggccgggcacagtggctcacgcctgtaatcccagcactttgagaggccgaggcaggtggatcatttgaggtcaggagttcgagaccagcccagccaacatggtgaaaggccgtctctactgaaagtataaaaattagtcaggtgtggtggtgcacacctgtaatcccagctactcgggaggctgaggcaggagaattgcttgagcctgggaagtggaggttgcagtgagctgagatcgtgtcactgcactccagcctgggagacagagtgagactccaactcaaaaaa

SEQ ID NO: 264478 - DNA, 320 bp, Homo sapiens
ctgacacatagcagatcttcaggtgcaagagattcagactctttgtgctctccttcagcaaggcacaggttgaactcaggaaaagtaagtcagagattaaataaatgtcttcatataaaggtgtgagtttacaaagaagaatcaaatgaggaacccaagcaactgttgctttcacataacttggaggtttctaaggcagtgtttctcaatgtcaagatgtcacgtttcaaaagacaacctgaattctcagatgatttcaatgcaagattaattttcacttgcctccattttacaaataaataaatgccatactgtgaaaa

SEQ ID NO: 264479 - DNA, 300 bp, Homo sapiens
ggagaacccgcagaaacggcaccatgcactgttctccgggtgagacttaagcacacacagacctcgggggtggccaggtcttgctgcgtcccggagccattggggcctgtggctgccacaaggggcatacctaccagagaggacctttccatcgtgctgaagggacggttccggtggcgcaggccagagaaccgccttgagtgctgcctgcgggcagtgctgccggccggccctgagcctgcacagacgttcacactgactcctgcttgccgaagacactgctgcttggtgatgctgcgc

SEQ ID NO: 264480 - DNA, 447 bp, Homo sapiens
ttttttttgagatggagtcttttctggcactcaggctggagtgcagtgggttggtcttggcttactgcaacctctgcctcctgggttcaggcgactctcctgcttcagtctcccaggtagctgggattacaggtgtgcaccaccacacacaactaatttttgtattttcagtagagacagtgtttgtccacgttggccaggccggttttgacctcttgacctcaggtggtccacccgcctgggctcaagggatctccctgccttggccacgcaaagtgctgagatgacatgtgtgaaccactacgcctggccctctttttaatattcatttgaaggcgctggttttgttttgcgaaaggtgttgtaataaaagtgaatttttatcacaatgttgggaatgcacaagtattcaaagctgtagttgttgaattaagcgagattgggaag

SEQ ID NO: 264481 - DNA, 437 bp, Homo sapiens
cccttcgggcctcctgccctggaggtcatctcccctagaatacagtgtctgtggagaagacaggcccacctactgggctgcccctctcctcccaccagctaggggagcaagaactcagaggagagcttcagagcatcagggagggggcgcatgactgcctgctgagcttccagtgtactggccctgtttcaacatctgaggagccgtgagcccctcgagccctctctggcccctgggttcctgtctgtcaaataaggagttcagctgatggctgagtttcttctgtttcagcattttggctctgtgaactgcagggacaatagcctgaggtccctccagccacctctgcctcagccagcaggacaggttccagacgtttttccagtagctttcaggctgaaggggagctggggccacgctgaacccaagggggagat

SEQ ID NO: 264482 - DNA, 423 bp, Homo sapiens
tagagacagggtcttgctgtgttgcccaggctagtcttgaactcctgagctcaagtgatcctcccaccttggcttcccaaagtgctgggattacaggtgtgagccaccacaccctgttggaagtcttctatccaaacaaaagggggagtagcgcttggagcggtggcagccatcttgtgactaggatggcagggccaggaggtactgggagatggtgacgcagagctctgacaccacggaatgtagggaccggcttggagctccttccctccagactttctgctctaagaggcaagtcatgctcttactatttcaggcatccttagttcaattttctcttacttatagctgcatgtgccaaactgccagagctcattttgtggatgctgaggtagattcgtctattgatgaccatttactttg

SEQ ID NO: 264483 - DNA, 401 bp, Homo sapiens
tccctcaatgtttttttactctttttttctccattctgttcctgacacccaaattcaggtcttcatcatcatctgcctcatctatggcaataacccgacaacttttccccagctccgtatctccttctttcggtttattctccacactgccatcaaaactctttcaaatatacagacctgactgtattacaccctttgactaagtatattttatggctgtcaaatagctaatgcacatgatgctaatactaattccttagcctagcagtttacgtgcatcacgacataaggcttcaggttctgccattaaccccgtcatcagaaaacacagcctatggcaggctttatcaaagcatgagcaatctacaaaacaatcatataggcacttacaaaaaatataa

SEQ ID NO: 264484 - DNA, 554 bp, Homo sapiens
gaaatgttttgttagccatcaggcaaactgaaaatagatttagaaagtatttaagattcattttttcaatgcacagtaattgagaaacctgtatgtgccaggcactgtgttagcactggagctctaaagggcagaaggctgaatgtgatagatggatctctaccttcagggtgcagtctagtaacacatagaaggactgagaccaatagccatgttgaagaggagacgatggttctcccatcaccttcattactccacctgctgctcatgaaggttgctgcgggatgtgctgattaacttgtgttttggtcgaaatctgaagtgatgctgaatcttcgtcctttaatgttgtctgttttattgttgaacaattttatcatgcatcgtgtgaacttttatgcttatggtgtgtatcatcacagcactggacaataatgactcacacagtagaataacataactgtatacttgcatcaagggtagttaaaacatggtaaggttttctcatgtctttattaataatgattaaaaaattaattattcacctctgagtt

SEQ ID NO: 264485 - DNA, 293 bp, Homo sapiens
ttttttcttccaagtttttttgtagagatggggtttcactatgctgcccaggctggtctcaacctcctgggctccagtgagcctcccaccttggcctcccacccaacatccttgacatcccaccttttgttctatttctgcaggaatcgctgtgtgtagaaagaaagcctttggtcagtggttcccagacttggctaggccgggatatcatctgagaatcctgtaccccgagtttgtacacacacccctagattcctttgctccacccccaaattggactcatttgggctcgg

SEQ ID NO: 264486 - DNA, 281 bp, Homo sapiens
gcaggaggtaccatgtgattgatgggttaagcacaaaatctccctctttgaaaaccaagacatttcccatctcattttttcctcaagaacttcacacggtgttacctgcagtctggcatatgcatgcagacacatactcagaacaatttcctgaacgtcaggaactaaagctgacatgataagtctgggaacaaaacaaaggcagagcccagaaaacgaggaactgctgtcaatagcaacagtcgctgatcacagcggccccttaggctctcacagctgct

SEQ ID NO: 264487 - DNA, 487 bp, Homo sapiens
cagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggcataacttt

SEQ ID NO: 264488 - DNA, 445 bp, Homo sapiens
tattctcttaatcatgttttagaatatttttgcatactatgtaatacttaagtatatgagtaaaatgtactaatattgatctaaacattgaaaagtgatctttagtaatagaaggataagataaaaatatgtagacaccactcatttagacaaggctatacccaagtcatctctgttcatggatttaaagaggcttagtgaataaaatatacatgctcagattccataaaaaatgttacctttggccgggcgctgtggttcacgcctgtaatcccagcactttgggaggccgaggcaggcagatcgcgaggtcaagagatcgacaccatcctggccaacatggtgaaagcccatctctactaaaaatacaaaaattatctgggcatggtggtgggagcctgaaatcccagcttctcgggaagctgaggcaggagaatctcttgaa

SEQ ID NO: 264489 - DNA, 352 bp, Homo sapiens
tgggcgaaatagtccctgaaacctgcccttctgtgactgggcctcactaactcacgataggattgactgggtcatatattaatttgccaagtcagacctccactgtgcattaaacatacccctgacaagcagcatcgtttgttttcacagccatcatactgggtaattaaactgaagtggagatactttacagagatcatttgatgtgttttttcccagcttgactgaggtataattgacagatgaaaattatatctgtttatggtatacgacatgatgttttgatgaatgtataccttgtgaaatgattaccaccatgaagctaataaatgcatccatcacctcaaaaaaa

SEQ ID NO: 264490 - DNA, 1047 bp, Homo sapiens
cagtcacaagaggctctcagcagctctacagccaacaaacgtggttggtttgtcctttttttttttgttgttaggtgatgtattcattttctattgctgctgtaacaaattaccacacatttagtgactttaaaacaacactaatttattaccttatagttccagaggtcgaaaatctgcaacaattctcactgggctaaagtcaaaagccgtgttgctttctgaagtttccaggaaagaatccctttcctcgctttccccggttctagaggccgctcacgtaccttggcttgtggctccatgccttcatctttaacatcagcaatgttgcatctctgtgcctggcttccatagtcatatcttcctctggtgcttccttctcccacctcccctcttccacttttaagggcccttgtgattacactgcacccacccagatattctaggcttgtctccctattttaaggccagctgattagcaacctcgaatccatccgcaaccttaattccccttttccatgtaacttaacgtattcagattcgaaaatgaagatgtggacatctctggggggtcaatattctgcctaccacagttgccacatttttctttttgatttttttagaacataatatctagctttctaccttttcttaaacaaagatctggcaacacaggacccaattcttgcctaatgtgccccattacagtatggcagcaatgatcttggattgagctgctccctgtttgccccaggccccacctgccttactgcaccctcatacaatgcccagagtaggttgcattaggcggtcagttatcccatcagacgtgcttcattcatttgcatttccccctggccttatcagcctttgagcttgcagcacctccttgtaactattaggaaaagccaactctacacttttgctatctgtttacatcagaaatatcacagagtactgcatgccactggtgcacacccacatgtgatacaggagaggggagctcaaggttatctccaacccagggacgcacagcagtggagaacc

SEQ ID NO: 264491 - DNA, 863 bp, Homo sapiens
tggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgagaaaaaaaaaa

SEQ ID NO: 264492 - DNA, 629 bp, Homo sapiens
tgcacaccaccctggattacagagtgagatacacttctttcgaggaaaaaaaaaaagtggggggggtccagttcacgcctccgcgccattcaacgcctccggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgagaaaaaaaaaa

SEQ ID NO: 264493 - DNA, 454 bp, Homo sapiens
gcaatctacatacatgtaacagttgagatacccagagtaaatcaaagttttatgagaagagattagaaagtaaaccaagatagacctctgatgaataatcatatttagaactagacccaggactaaaaaatacaagtagagaaaaagaagaggtaagcagaggcttagaaagattaccatgaggtttagattcaaggcaagggagaagaaagtctcaagatggtgtttcaaaacaccatcagtggccagacacagtggtgcatgtctataaagctacttagaatgctgaggcaggggaatcgcctgagcccagcctttgagattacagtgagctgtgatcatgccaccttactccagcctggatgacagagtgagaactcatctctaagaagcaaaacaaaactaaaacaaaaaaccaccatcagtggtgttttatgtcaaaattaatttaagt

SEQ ID NO: 264494 - DNA, 459 bp, Homo sapiens
gagtaaagatgggatgtggctgagcttttaagttgttttcttaaacatgattgcagttctatgtttaaaaatgagtcaagaacatctgcttctttctagggagatattccatggcttcttaacaactgctctaacttttgtggcagctgtctgaaagttagctgtctcttgaggcagtgatgtctttatcactagggggttttcactaaaatctcagtgatgacttgcagatgtcatagatgttggatgaggggaagggaagttgaattacatggcattggagatccttcctaaccctgagagtctttgaggttctaagttccattaaaactatttcaggacacagttaagagcagagcagcaatctttaggtcagtgttttatggcatttggccaaaggccatttaaaagttgatggagcaaagagaagtggatataatgggattttgaaaaaaaata

SEQ ID NO: 264495 - DNA, 1158 bp, Homo sapiens
tgccccggaagcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccgggtcctcatattttgtgcttgcaaatggacatatcctgcccaacagtgaaaatgctcatggccaatctctggaagaagattccgcattggaagctttgctgaattttttctttccaacaacttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagtgtttgcttgagcaagtcctttaactttcttgggcttcatttcaccaatcttcagaatgagaaggttgatttgatgaataggagaagtgatttatctcagaagaaaaaaaagaaaatctttatataagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaaaagaa

SEQ ID NO: 264496 - DNA, 428 bp, Homo sapiens
ggaataacttgagtggtccttaaccccactttattgagacttgaggttgagaggtacgctgggataaacatgggtttttgtttctccataggtgaataagccacagagtagattgtgtctggtaagatgaggactctggctggcttctccagcaacctggccccctgctttaaggactatggtctgtcgccatcactgcgtatgtctgagcagcccgttaatttgaatatattttgtagtcaagaattgatagacaggtagaaattttatttgcatgtaaaaatacataatacatacaatgagtcaaagaacaattttttttcaataatctgcgatttgtgtcattcatgtattgacatggatcattgagagctatggggttatgctgacttacagcccagtagcctgtattgctgagaaattcattg

SEQ ID NO: 264497 - DNA, 414 bp, Homo sapiens
cttaaaaatgaagaagtggtgttagccacataactctgaatttactaaaaactattgaattgtatgtttaaatgggtaacttgcacatatgtgaatgatagctcaagaaagcttttaaaaactaacccttgggctgggtgcggtggctcatgcctgtaatcccagcactttgggaggccaaggccggcggatcacaaggtcaagagttagagagcaacctggccaacatggtgaaaccccgtctctattaaaaatacaaaaattagctgggcgtggtggtgcatgcctatagtcccagctactcaggaggctgaggcaggagaatcacctgaacctgggaggtggaggtttcagtgagccaagattgcaccactgcactccagcctggcaacagagcgagactctgtctcaaaa

SEQ ID NO: 264498 - DNA, 355 bp, Homo sapiens
tttttttttagtagagacggggtttctccatgttggtcaggctggtctcgaacccctaacctcaggtgatccgcccgcctcggcctcccaaagtgctgggattacaggcatgagccaccatgcccgacctgacaaatgcctagttttaaccaaaaaatgaatatgttctaagtcggatgttggttaaaatgcacataattatccacataaagtgaatcattgaaagcctggggtttttattttccttttttatctctctccttctctttctcgcttacctctatgaagcttcccattctgacctgagaactcagccgtgcattattactactcacaccagatcctcttcccaaat

SEQ ID NO: 264499 - DNA, 455 bp, Homo sapiens
tgatgtgccctaaaaactaaaagtatataatcaagacagactgcaaacaacctcgctatatcgcatagaagcattgtttcagagttccaaccaggcgggacacaagtgaatatcctctaagaggctatggaatctgtgacaccccattccccgattctcctagttcaaaaccaggtttgggggatcaaagagaggtgatttactagttggaagccaaaaagttgaagtttctgatctttagatcccatttaatctcttgagaagatgtatgatttgggagcatcatacatttgttttggggtaaggaaggcaatttgtatgtgtgagtcccacatgaacacgcacaggcactaaaatggcactactttgggctcgagaaacacagagtgaacacaacacacaaaagttgctatcatggagtttacaagctagtgtcgggaggcaatcaacaaaaa

SEQ ID NO: 264500 - DNA, 443 bp, Homo sapiens
ccacgcccggccccggagcaggcttttacgcatgccccgcgcgcccccttgtgtccggaatttattccttccggtgggttcgcggtctagctgaccaagaacggaactggggactttcgcagtgagagttacagctcttaaagatggcaccgacccaggccgggcgcggtggctcaggcctgcaatcccagcactttgggaggcggaggcaggtgaatcacgaggtcaggaaatcgagaccatcctggctaacatggtgaaaccccgtctccactaaaaatacaaaaaattagccaggcatggtggctggcacctgtagtcccagctacttgggaggctgagccaggaaagtggcatgaacccgcgaggcagagcttgcaataagccgagatcgtgccaatgcactccagcctgggcaacagaaggagacactgtctcaaaaa

SEQ ID NO: 264501 - DNA, 942 bp, Homo sapiens
tagtcattaacttttaatattactctttgttgcatcattaatataacctaggaatcaccggcgggtatagggtcaggtgctgaagggacattgtgagaagtgacctagaaggcaagaggtgagccgtctgtcacgcccatataagggccgtttgagggctccttggtcaagcggtaacgccagtgtctgggaaggcacccgttacttagcagactgcgaaaggcagtctcctttctttgaaggagtcagggaacactctgctccaccagcttcttgtgggaggctggatattttccaggcctgcccgcagtcatccggaggcctaaccccctccctgtggtgcttcactggtcacgctccttgtccactttcatgctcctcccatactcctggttcctctttgaagttcacagtagatagcggtagaagaaatagttaaagtcttaaagtatttgatctttcttagaaatgcatagaagaaaacgctgacgtttgctgccttccctctctgcttcagctacctaaaagggaaggggcccctgtcctgtgatcacgtgacatgcttcaccttgtcaatcactcagaagattcaccctccttaccctgtccccttgtcttgtatgcaataaatatcagccgtttggggccactaccggtctcctcctcttgatggtagtggtcccccgggcccagctgttttctctttatctctttgtcttgtgtctttatttattataatctctcatctccgcacacggggagaacacccactaagccccgtacggctggaccctacatgttctgaggaaaatttatagtcattttaagatgacttcattatggtgggattacagaagtaagccacccagcctcgtgactacattattaatgaagaaacgattcaaaaagcttagtatatatcttacaaatggaaaaaaaata

SEQ ID NO: 264502 - DNA, 264 bp, Homo sapiens
gatttccagctgatgcctaagtggatttttctggaagaaagaatgtatctttagaaagcagagtgaggatccttcctaatgtaatttgaaacatagtttcgtatgtctaacttctgctttgcctcatgctcactgaaatctacagctagcctcattttccacttgtttttgactctctcaggcatcttgaggattgagatcatgtcgtagttatcttttagacttagtaaatgagtaataaatgtttcttttgagtgactcaaa

SEQ ID NO: 264503 - DNA, 457 bp, Homo sapiens
caaaatgctgagattacaagtgtgagccactgtgctcagccaaaataaaatgtttcttattctctgatcccactaaagggacaaatcccatttcagttaaacacccagtcataatcttaagtcttaaaccttggcgcaagtgccagttaatgagaaatgacatctccttgcttggacctacatttgttctttattcctttatatatttaccgagtacccgccatatgccacacacagttctaggattggaggagggagcaaagagcaaaaacacatgggttctctctcatgatgctcagtttgctgacgatacaaggaacaagagaaaactctgcagaagagatattttagctgacatgggaaagatgaaggagttaaatggggcaagtatttcaggcaaaaggagaagcaattttcaaaggcttgaggaggacagtggagcatgctgggacactta

SEQ ID NO: 264504 - DNA, 324 bp, Homo sapiens
agggatccaccatccagctagctcacattcctcagcagccagcaggaagcttccggagaagaggcagctggctctctgtgaagcatggaaggcctcatgaattggcccatagcatctacctctgcaagaggattggaaaagtgcctggaaggaaggaggaatgagaaatgctcttgggtgaagaaagctttcatggaatggagttggagctggggtaggaggggctacggaggaggaggaacccaagcttgtgtaacagtacctgctacacagcaggtgctcaataatgatttgttgttggaataaatgagctcctggttttcc

SEQ ID NO: 264505 - DNA, 340 bp, Homo sapiens
gggagaggggcagctcctcagacggagagttagggagaggagggggtatttggagccaggatagacagagcagcgtggtgctgggacagcaagaaggggcagctggtgacaaggagagcagagggagaaccacagcagggggagacctgggatctgggggtgccaaagagtggggacaaggaagtgaaacagggaagaggggatttaacagggagagcagagataagggaagaaagaggcagaggttgcagtgagccgagatcgcatcactgcagtccagcctggatgacagagtgagactccatctcaaaaaataaataaataaataaaaatgaaatta

SEQ ID NO: 264506 - DNA, 250 bp, Homo sapiens
caccatattggccaggctggtcttgaactcgtgacctcaagtgatccacccgccttggcctcccaaagttctgggattacaggcgtgagccactgtgcccggccttaaaattatttatgttttcactcctctaggttgtgtgtatgtgcccacctttctgtttttaaacacgccgcttcttggcctggggagcccttttcgtttttctcgctccagctagcccttgcccccttgtcagttagtgcttgtt

SEQ ID NO: 264507 - DNA, 494 bp, Homo sapiens
ggacgttgctcattccttatgttttccaagtccacaaaacccacatgatacagtggatatttctgtgggagttggacctacacatgatctttaatagaggcctggcctgggtgtccatgttttgattcagatgcattggctttaagtaatagtaaatcccaactgaaattgacttaagcaataaagaaacttaccacacataaggccgggcgcagtggctcatgcctgtaatcccagcactttgggaggccgaggtgagtggatcacctgaggtcaggagtttgagagcagcctggccaacatggcgaaaccccgtctctactaaaaatacaaaaattagctgcatgtggtggcatgtgcctgtattcccagctgcttgggaagctgaggcagaagaatggcttgaacccggaaggtggaggttgcagtgagccgagatcacgccactgcactccggcctgggtggcagagcgagactctgactcaaaaaaaaa

SEQ ID NO: 264508 - DNA, 624 bp, Homo sapiens
tgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagctagtagttcatgaaaatatttggatctagtttctaagttattttagtgttttatatgttccccaaaattactttgaatctgtcaccagcataatgagttcttggtgatacaatggtgagacttgtaatgagc

SEQ ID NO: 264509 - DNA, 537 bp, Homo sapiens
  misc_feature (2)..(2): n is a, c, g, or t
  misc_feature (371)..(371): n is a, c, g, or t
gntgtactagaggatcccagcgctgagcaatacaaaggctaagaagggcagatctgatctgatctgagccaagaagcgatggctcctaagaaaataacctaccagcatctcagaaactccctttgtcttcccatgtttgaggttctacccaggaagcaggcaccaaatggaaatatctgaaaccatcccagcaacccaaccacagctggttctccctggagaccatgaaccacactgtccaaaccctcttcactcctgccaacaccggccgctccaccaaccatgagatgctcaaggagaagcatgaggtggctgtgctgggggcaccccacaaccctgtgcctccagcgttcaccatgatccagcgtatngctcagcgctgacatactctgaatatggttgtagggggggagggggtgtgtgtgtgtgtgtgtgtgtgtgtgtgtatgtgtgtgtgtgtgtgtacacgcgctgtgtccatcagtatcagtgcctgcctagagtaggaaaattacatcccgtggtctgtatggagga

SEQ ID NO: 264510 - DNA, 654 bp, Homo sapiens
ccagacgacagcaactctggtaagattcagaaccatcccagcaacccaaccacagctggttctccctggagaccatgaaccacactgtccaaaccctcttcactcctgccaacaccggccgctccaccaaccatgagatgctcaaggagaagcatgaggtggctgtgctgggggcaccccacaaccctgtgcctccagcgttcaccatgatccacatctgcagtgagacctccgtgcccgaccatgtcgtctggtccctattcaacaccctcttcaagaattcctgctgcccggacttcatagcattcatctactctgtgaagtctaggacaggaagtctatggacaggaagatggttggtgacctgactggggcccaggcctgtgtctccactgccaagtgcctgaacatctgggccctggctctgggcatcctcctgaccattctgctcatcatcatctcagtgctgatcttccaagtctctcgatagaacaggagacagcatccgggccaggagctctgcccacaacctgtctcccatgcactccgccttccattccttgccctgcccccaaagctgagtcctgtatcagccctttatcctcacacacttttctacaatgtcattcaataaagtgcatgtgttcgtggtgc

SEQ ID NO: 264511 - DNA, 692 bp, Homo sapiens
ccagacgacagcaactctggtaagattcagaaccatcccagcaacccaaccacagctggttctccctggagaccatgaaccacactgtccaaaccctcttcactcctgccaacaccggccgctccaccaaccatgagatgctcaaggagaagcatgaggtggctgtgctgggggcaccccacaaccctgtgcctccagcgttcaccatgatccacatctgcagtgagacctccgtgcccgaccatgtcgtctggtccctattcaacaccctcttcaagaattcctgctgcccggacttcatagcattcatctactctgtgaagtctaggacaggaagtctatggacaggaagatggttggtgacctgactggggcccaggcctgtgtctccactgccaagtgcctgaacatctgggccctggctctgggcatcctcctgaccattctgctcatcatcatctcagtgctgatcttccaagtctctcgatagaacaggagacagcatccgggccaggagctctgcccacaacctgtctcccatgcactccgccttccattccttgccctgcccccaaagctgagtcctgtatcagccctttatcctcacacacttttctacaatgtcattcaataaagtgcatgtgttcgtggtgcaaaaaaataaaaataaaaataaaaataaaaaaattaac

SEQ ID NO: 264512 - DNA, 668 bp, Homo sapiens
cttcctcctatgaatcatgaatgttctcactaccatctagaatgaaccatcccagcaacccaaccacagctggttctccctggagaccatgaaccacactgtccaaaccctcttcactcctgccaacaccggccgctccaccaaccatgagatgctcaaggagaagcatgaggtggctgtgctgggggcaccccacaaccctgtgcctccagcgttcaccatgatccacatctgcagtgagacctccgtgcccgaccatgtcgtctggtccctattcaacaccctcttcaagaattcctgctgcccggacttcatagcattcatctactctgtgaagtctaggacaggaagtctatggacaggaagatggttggtgacctgactggggcccaggcctgtgtctccactgccaagtgcctgaacatctgggccctggctctgggcatcctcctgaccattctgctcatcatcatctcagtgctgatcttccaagtctctcgatagaacaggagacagcatccgggccaggagctctgcccacaacctgtctcccatgcactccgccttccattccttgccctgcccccaaagctgagtcctgtatcagccctttatcctcacacacttttctacaatgtcattcaataaagtgcatgtgttcgtggtgc

SEQ ID NO: 264513 - DNA, 1365 bp, Homo sapiens
  misc_feature (20)..(20): n is a, c, g, or t
  misc_feature (141)..(141): n is a, c, g, or t
  misc_feature (1177)..(1177): n is a, c, g, or t
atgcagctcagcctgggctncacagccaggtgtcagatgtgtctctgctgatctgagtctgcctgtggcatggacctgcatcttccctgaagcatctccagggctgaaaaatcactgaccatggcaccatggtctcatccntctgcacagctgcagccagtgggaggagacgccgtgagccctgccctcatggttctgctctgcctcgggctgagtctgggccccaggacccacgtgcaggcagggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttntttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggagga

SEQ ID NO: 264514 - DNA, 571 bp, Homo sapiens
tggtgaacaggatttgtgtagcctatgttcattgtcatgtcagtgaggtcaactgacagaaggagagccagaaaataaaaaataaataaactgagaggaaagattgagttatttgatggactgattgcctcgacacctctgctcagagaaatgcattttgccaaacgaatggctcatctagttatcacttgaaaggctaggcaatttgtctgtggacaggatacagaagaatgaatgtctatggctagcccatagtttcagctgggttagaaacatcaggcttgactgataaagctagaggttgcttttctagacttttctccttgggggtttaccagatgcacaggagttaaaaggaggatgtggaagcataacagatgacatttgtggatatgtctaaactgatcattaaaaagatgccagcaatcctcaatttttaaagatttgcatataaaacgtaccttttgtgaaacctttccattaaatctaatgcataaggaacttcattattaattcctaattttaaaagcaacaaataaaggaaacattattgaacatttaaaaaaaaaaa

SEQ ID NO: 264515 - DNA, 451 bp, Homo sapiens
tgctgggattgcaggcgtgcagcggctcccggcctcgcctctgcttctttcacagttgtttgtacagctggccgcccagtggggacttgagcaatactaaaagaaccatagattcttccattgcaattctttccgttggctgtctcctgttttcacatacttccttgagccagaggtcatcccattcctctcccttttcccaaaagggctttctctctagggggtcccccccaacccaacgtctttggaaaaggacagtctatggcttactatcaacgatgtaacaaaattttggccatccaagaccatattttcatctaatcacttggtccacccaatccagtagagatgttcttaggcatgtattttcacacgtgctttgatgacaataaagagaaaactgccccatccagattcttaaataaacaaaagtaattactctaaaaaaatt

SEQ ID NO: 264516 - DNA, 232 bp, Homo sapiens
cccattctagctgaagaaagcataggcatgttagaagtatgaactgccactaaaaaaaaaaaggagaagaaaaaattccatcttgaatcagacccatggtctagtgagtctatgcttctttcacttcccccaccctgtaaagtcagggacagggattaagattttgtcatttcgacaaacccagaacctgccacagggcctgacacacagcaggtcctgcataaatgtttgc

SEQ ID NO: 264517 - DNA, 1085 bp, Homo sapiens
gcggggaggtggtcccaagcctgtcagtgggaacgagggctgctgggaaacccacagtccaggtctctccccgagtgagccctccggtccttaccagcgtaataaatgggctgctgtactggcctcaccctgcattagtcaggatgctcttaacaaatgaccatgttcctgctcagaaaccgcccaaggctgcaaagagcaggaggaccaagccaggagaagccctgggccctcctgactcccactttgggctctccctgccctggtgaaatgacagaacggccaacttgacacgctgaagctgctctgtctcatgcgtcctcctcatttctggatccagagccagggctgccaggagtagccagagagctctgtgtggtgatgttcatattagtgaggtttaccttgaccacgagcagtgggaaactcaaaataatggtggcttatttctcatctaaaaacatcccggggtgggtggtctgggactgatctggtggacccaggctccgccttgttgcttgactgttggcagcacctgcttacttaccactcatggtgcaagatgacacttcagcctccgccaaaatgctcaccttccagccagcaggaagtcggaaggagaagaaaggggacagagccccatggcgtccatccttagaggatgctgccacctgaacctctgctttcatcctgttggtcagaacccagtcacatgaccacacccagtggcaacggaggctgggaaatatagtctttattttgggcacccatgtgtccagcaaaactgggggttccatcagtcggcaagaacgggagagtggccgatgcagtggctgatgcttgtatcccagcactttgggaggtcgaggtgggcagatcacctgaggtcaggagttcaagaccagcctggccaatatggtgaaaccctgtctctactaaaaataaaaaaattagctgggtgtgctggcgcacctgtagtcccagctacttgggaggctgaggcaggagaatcgcttgatcttgagaggtggaggttgcagtgagccaagattgtgccactgccttccagcctgggagacagcaga

SEQ ID NO: 264518 - DNA, 207 bp, Homo sapiens
cacatttaactgggtgtcttgggtcgttttgctaaatctggcagcctgtctaggaagccctctggcttgtttgctgtggcccacagccctcagtggttcagctttgtgtctctgtggaaggccccagacccccattcccccagttcccatccttaacagggtaggagcaggtggacggctgtgtgtccagcacaaggtgtttccata

SEQ ID NO: 264519 - DNA, 291 bp, Homo sapiens
attgggaagcagtatgcctaatgggtaaagcgtagtctctggatacagggcgtgggtttaaatttcagctgcactacttctagctgtgtaacttctaacaggctatttaacctctctggtcttggaatctttagctgtaaaatgggcaaataatagcactcacaccttagttgatgtgaggattaactgaatttgcaaagaacttaatgcatgtgattcttgattacttgaattgtcataaatgtaattccaagcttggaagtgttttaaggaaacttaataatgtttttc

SEQ ID NO: 264520 - DNA, 516 bp, Homo sapiens
acccgctaatctgtgacaccgggcaagcactactgggattggactttcctagcattgtccaattgaaggttgagacaacaaagccctacggactgggacagttattgggaccaaactctcctgagagctggcacgagtggacaaagagaatgccgcttgtcactgcatcgtgggcttccagcctatttgactggctggctgacacaggctgacacttgcaccctcagctggcagaggccagagtgttctcactgatggaaaagccaagctctgaggacataaaacaagacccaaggagcacctcatctggtttttgtcttggggacccacagcaaaattagtctgaacagacattggtttgcagagaactgtgaactcaccagtctttgaggcctgtgttcttgccctatgattctcttctgtatgacacaacacaaaagacacagacatgggaaaataatgaccatctctgggaggggaggaatcagaaaacaataatacctcccctcaccacca

SEQ ID NO: 264521 - DNA, 634 bp, Homo sapiens
tcacaactgtaatcccagcactttgagaggccaaggtgggcaaattgcctgagctcaggagttcaaaaccagcctgggcgacatggtgagaccacatctctactaaaaatacagcaagttagcctgtcatggcggtgcacacttgtaatcccagttactcgggaggctgaggcataagaatcgcttgaacccagcaggtgcaggttgcagtgagctgagatcaggcactccagcctgggtgacagagctagactctgtctctgagaagaaagaaagaaagaaagaaagaaagaaagaaagaaagaaagaaagaaagaaagaaagaaagaaagaaggaaggaaggaaagaaagagaaagaaagaaagagaaagaaggaaggaaggaaggaaagaaagaaagagaaagaaagagagaaggaaagaaagaaagaaagagaaagagaaggaaagaaaaagaaaaaggcagaaaagaaagagagagaaagagagaaaggaaggtaggaagaaaaagagagaaagagaaagaaagaaagagaaggaaggaaggaaggaagattctactcttagttgaattttttaaaaaatgattagatttgaattaagaactgccctactgtagagctcattttattga

SEQ ID NO: 264522 - DNA, 219 bp, Homo sapiens
ctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcact

SEQ ID NO: 264523 - DNA, 448 bp, Homo sapiens
tgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggat

SEQ ID NO: 264524 - DNA, 380 bp, Homo sapiens
ggtcagagtaaggaaggaatatcatcagaggcacaggaaggggatgtaagtaatttttttttcttcaactttaagttccagggtacatgtgcaggatgtacaggtttgttacataggtaaacgtgtgccatggtggtcagctacacagaccatcccatcacctgggtatcaagtccagtattcattagctattcttcctgatgctttccctggcaatttttgtaatacttctggtattaaataagttaatgatctcaaataaagcaatattgggaatcttatcagttacagatttaaaaaaaaatttccaaaattaagttttgtactttgtacagctgtcgaataaaagtcttctcatgtttaacatttacttgttgtct

SEQ ID NO: 264525 - DNA, 521 bp, Homo sapiens
tttatcacaaaagtttgtgtcacagttttttggtccctgaggttacacagtgaagcacacttagtctctgccaacagagaagataagaatacatgtaaaaataacagctataaatatgccagcattgggttaagtgccttttcatgccctttctcctttagtctgtacaaccttatggggtaggtcctgtgttccccatttcacacagaggctgaaacaaagcagtttaaaaacttcccatgggtcgggcacggtagctcacgcctgtaatcccagcactttgggaggccgaggcaggcggatcttgaggtcaggagatcgagaccatcctggctaacatggtgaaaccccgtctctactaaaaatacaaaaaaaattagccaggcgtggtggtgggcacctgcagtcccagctactcaggcgcaaacccgggaggcagagcttgcagtgagccgagattgcgccactgcactccagcctaggtgacagaacgagactccatctcaaaaaaaaaaaaaaaa

SEQ ID NO: 264526 - DNA, 690 bp, Homo sapiens
gtttttgttatatgtttaaatttcagattctgtgataaatgataccttctgaggagtcattctctctctctgagggaactctgaatgcattttaagcaagacaaaacagaaaatgcaaatgggagtaagttccatgggtccaggaaagaaagagaactcaacatcactggagagaagtgagtaagagagcaagtaatggtcaggggcagctcctgtaagcccgcttctcctcctctctttagaaggcagtaaagcagggggaagggatccatttctagtgtccttacatgagtccagagcccagagttgccgctcacaggctcagtacccttggaccagttgttcaacttctgtctacctcagtctccttaactttatgatggagaagataatagaacctacctccaggaactgtgtggcttaagtgtgctaatacatgtaggtttagaatgtcatctgggcacaaagtaagtgtctgagtgttcaaaaaaatgttagtggtttatattgtcattcctctgagtagaagctactgctttatctaagaaagacacaggacagacctaggggttgattttttgagacactggtgcctcgctctaggtgtttctcccactactggttcaccttagccacatatgattgatttgtaaagatcttttacattctgaatcagcattcataggtcta

SEQ ID NO: 264527 - DNA, 674 bp, Homo sapiens
gagctggagaggatggaggctacagttacaggttaaaggcgatgaacttagtgaatccataattacacaaatgacttagaaggtagaaaggagacttttctataaaagcagatagaaaaatgaggtcaacatttaaaagctgatgtgactaataagcagatcagtggctgctgggctaggggtgggagcccagattgactgcaaatgcagatgaaggaactttcttggtcaaagtgtctaacactggaatgtggtgatggttgcatgattctatgcatttattaaaatcattaaataatatacttaaaatgggtgctttttgtagtacgaaaattatagcttaataaagctgtaatcattttttattttaaagttgacatgtttttaaattttgcgatattcacactctataaaatagttgtactgtatatctctgtgatgtgttagttacattaaaaatgttctttttccactattgggaatataaatttttataataatctaaagtaagattcttaagtttttaaaattactctaaatggattattttcataatcattaacaatccaaataggaatcaaaatagcaagaaacacttagaagaaattgaaagaagacatttcagtagctttctcaacatttactgtcttttggcaacccagtctaaccctttt

SEQ ID NO: 264528 - DNA, 360 bp, Homo sapiens
tgtttgtgaggattaagtaaagcacttggaacagtgcccaacacacagagctcaacaaatgtttactataatcctaattatctccgcaggtttcacctggacaacatgtggggcgtgggcaggcagtgagaacacagatggtagccctcgaagcatcccagcctgaaaagcacatgagtcagcccttccttccacttacccactacctctcacgctggtcgtcttttttattttttctctctctctcttttttgagacggagtctggctctgtcacccgggctggagttgcagtgagccgagactgccccactgcactccagcctgggcaacagagcaagactccatctcaaaaaataaa

SEQ ID NO: 264529 - DNA, 407 bp, Homo sapiens
gttctctattctgtttcatgggtccgtgtgtctgtttttatgccactaccgtgctgttttgattactctagctctgtagtataatttgaagtcagataatgtgattcctctagttttgttctttttgttcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattccaccgcgcccgacctcccgtctcctttcagtcctcctcgggatcgcgcatcacccgcattttctggtctcctcctgcacttgctctcctcgcctctcctccgtctcctctcacttttcgga

SEQ ID NO: 264530 - DNA, 273 bp, Homo sapiens
ctctggaagaagcctggtctctcctacatcttgaatctgcccctcgctacttgcttctcctcccttctgacaggcaaccaaattagccatggaaggaacagcagacagacagagcagacagcccaggaaggagactttgaggacgctgcattttggacagaagggcgagggaaggaacatcgcagcaggaggaagcaatacaggaaatagaattttcaagaatctgtgaagcaccacaatacatttactataatgaattaaaaaaaattgaaa

SEQ ID NO: 264531 - DNA, 419 bp, Homo sapiens
cagcacgggcttgcaactggcgtctgaagtgggggcagtctaatgacagtcccattagacttcaaccagtaggggctgtgccaactccaggtagtgtcagaattggattgaatttcaggacttccagctggggttggaaaattggtcaatgtggggaaaaagttcacacatctggtttcagaagtgaagtattgagagtagttgagagtacagagaaaatcattacgtgtgtgggaattttcttcccctgtatttagttttgttttgctttgttttgagttaggggctccctctgtcacctagcaggagtgcattggtacaatcatggctcgctgcagcctcgaactgctgggctcaagtgatcctcctatctcagcctccccagtagctgaactacaggcgcataccaccttactcgg

SEQ ID NO: 264532 - DNA, 254 bp, Homo sapiens
tagtgttaaaaagacatatactcaatggttgagatttaatgaaagtaatacttattactgattcatcaaggtcattcttaaggacttttttctgtaagtgcaagaaatccagtgattagtagtgtggcactcttattttgattggtgctagggcaccagtagtagtttcacccactctttcttttgtatcatcagagcaaatgtcaacccagtgaaaaaggcaaataacatagtagtattatgaaaattgtttt

SEQ ID NO: 264533 - DNA, 633 bp, Homo sapiens
ggcgggccgctcccacttcggcacgaggggcacgaggtaaatcttttctgcttactgaaaaggaagagtctgatgattagttactgatcctctttgcatttgtaaagctttggagatattgaatcatgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaggatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaaaaaaa

SEQ ID NO: 264534 - DNA, 624 bp, Homo sapiens
tcagaaatcatgtgactgatgactaaggtaaatcttttctgcttactgaaaaggaagagtctgatgattagttactgatcctctttgcatttgtaaagctttggagatattgaatcatgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaggatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaaaaaaa

SEQ ID NO: 264535 - DNA, 621 bp, Homo sapiens
tatttctgtaaattgttgtgttagtggaggcaagaagagttcagggcttctgattctgccacattgctgatgtcattcttctggggagatattttcaatcatcatcaatttttcttattttataattttaatgcaagattcatcttaaaaggctgatattcagaatactatacttaatggagatgatttgtagtaatttattgacattatctttattgcttttagataaaatgcaatacccaatttcaattaatgttaacccctgtatagaattgaaaggatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaaaaaaa

SEQ ID NO: 264536 - DNA, 880 bp, Homo sapiens
ggcgggccgctcccacttcggcacgaggggcacgaggtaaatcttttctgcttactgaaaaggaagagtctgatgattagttactgatcctctttgcatttgtaaagctttggagatattgaatcatgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaggatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaaaaaaaaaaaaaaaaaaaaatttgtgctgcgcgcttgggccctggagaaagtttttaacacatctgtgtggcgccgggggcccattgggtacctgcacactgggccaaaggggtcccaaagataccccggggcaaggaacaaggcccggggtttccccaataaaaaacgcggggggaccccgaggttcgcaccactccaagggggtccggggcacaaccgggtctctcacaggggcccaggaaccaaaaataa

SEQ ID NO: 264537 - DNA, 445 bp, Homo sapiens
aaatcagaagtaggttctacttcacactctaggatggccagaagtaagaaatacaaacaccagaaaacagtgtatcagtgaggatgaatctggaaccctcaaacaatactggtaggaatataaaatggtgcaactgctgtggaaaatagtgtgatggttccagcccattgcagccttgacctcccaggtcaagcaaagcgaaacagaattaccctgtgacccagcaattccactcctagatacagaaaccaaaaggtgtgaaaacggcgttcaaacacatgcatgtccaagaaaaggccacagcagccaaaaggtggagaccacgctcatatgcgtcaacctgaagaacgaataaaccagtgtgctccatccatgcaatggaatattattcagcccatgaacaggaatgaagtgctgaaactatccacagtgcaggtgaatcaac

SEQ ID NO: 264538 - DNA, 217 bp, Homo sapiens
actattttctgacagataattctgttgtcctttgagaggcttgggaaatgattaggatcagtatggaagggcttttcacgttacaaactatttttagagttttcatttaattcacataaaaacaataagtatcacactgtacatataatagtcccttttcactgagcaagatggaattagcactttaaaatgacattggcatataatgagacctcat

SEQ ID NO: 264539 - DNA, 548 bp, Homo sapiens
tgagctctgctgtcttagtcaatctctctctgtctctctgattactcactctgtgaaaagctagctgccatgctgtgagcagccttgtgtagaggcccatgtggtgaggaactgaagtctctggccaacaatcagaaaggaactgaggcttgccaataatcatgcagatgagcttggaagcagatccgtcagccccaggagagtcctgagatgattttgccatcaattgaaagattgacttcaatctcatgagaaccctgagcctgaacctccagctaaaccacttccagattcctagacctcagaaactgagagataataaatgtttgctattttaagctgctaagttttagggtagtttattagataaaatagataatgaacagataagtagttatgagaaaattctcagaaaaaaaaccaaacagaattccaatgctcttatatggacaggatagggacttatttccctggctatagtcaatggtttgggataagcatctgatctagcactggtccaatcagaatgaacttggatatactggtac

SEQ ID NO: 264540 - DNA, 436 bp, Homo sapiens
ccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttg

SEQ ID NO: 264541 - DNA, 4416 bp, Homo sapiens
aggcgaaggcttggacccccagctgaggagtcctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacattgttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcacagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaagagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcggacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagagtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttctgttcttgctagaaacccagtgtagcccagggcagatgtcaataaatgc

SEQ ID NO: 264542 - DNA, 2914 bp, Homo sapiens
aggcgaaggcttggacccccagctgaggagtcctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacattgttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacaggtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcggacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagagtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttctgttcttgctagaaacccagtgtagcccagggcagatgtcaataaatgc

SEQ ID NO: 264543 - DNA, 400 bp, Homo sapiens
caggggaccgcattccagagtcagtgactctgtgaagcacccacatctacctcttgccacgttcccacgggcttgggggaaagatggtggggaccaaggcctgggtgttctccttcctggtcctggaagtcacatctgtgttgggtataggctaagtatctgctggctcccaaatcttccacttgccacagtgaggttgtgtctggtctgggactgaactatgcatctgccttaagacacagcaaggccttaagacctgaggccactttatggatttattcgtaatttataccctgtttgtttttctccaaaacttgagattgttcccattattaaaactcacaaaacagaacctttatatgagaagagggatgagcagtcattcagagggaggaaaaaa

SEQ ID NO: 264544 - DNA, 407 bp, Homo sapiens
taaaaagaaaaatcattaaaataaaaatatattggcagaatcctatcaaaaatggttcctattaatgacagatggacatgttaaaaaatcctcgaagttttattttcaaattctataagttatttcgtttctgaaataaatcataactttattaaacatggatgatagagtaaaattcattttctgcttccaggcaatacatgttgggaggagacataaaatgtattcataaagataaaaacttgaaagtataggatgtcataggaagttcactgcatttatacttagagatgtactataaaccaagttcaaacattaattgaatgagcaagaacaaatattttaacttccttaaactttgttctatcatttagaaaatgagatcttgttatatttgccaaatgctt

SEQ ID NO: 264545 - DNA, 332 bp, Homo sapiens
tcattaaggaaatctgcatgtataacagaaaggagatctcaactcctgctttgtgtctgtcttcttaagaacttagggaaaagtcacctttagaaagaggaaatggaaggctgggtaggagaagagcttctgtgagccaggcctcgatttggtatgaagaaatgacagttacattcaaacttgggatggtgtagagggtatccaagaagcttgtgggagtaggtgctttatcagatcccttttgagttaggttattagataaaatttgtttttatgtgaagctattttaaaaaaccttttcctctcgtggatgctgagatactgagttgaaa

SEQ ID NO: 264546 - DNA, 409 bp, Homo sapiens
gtgatctgatgacagacagcatcagaaactcaaatcctagcttctcagcccaaatttagtaaataaaaaccacagcaatgaaacagctagctctgtttgggagctcaaagctcacttaagcttgggaacattcccactcatgttctttctagtaattcatcagttcccctattgaagccctttccatggcccccatgctggcatttctgaatcacatctgagcaaccaacaactttctagggagaaaaaataactattattaaatttggtctggattaatggtgtggatgagtttgtatcacttcacttgctctccattttctatcttcttttgtctaactctgcatattgtgttttattttccctgataataaaaattgaattttatgtgccctttatgtagtaggag

SEQ ID NO: 264547 - DNA, 327 bp, Homo sapiens
ctctgaaactaagtgcctagtatattaccatgaatccatgatagaaaaaaatacacaaatatgtaaatgttcactgccttttctgtctcctaccaccaataaccccacctctatcccaggaaaattctggtgaagtctctcccttgactttcctgtcctcgaatatgccccctcaggatgtgttactgagttcaaaaagggggagagggggaggggtttgtatttaaagaagtaaaataaataggttgatttacatagaaggcaggcaagtgtgcctggaaaaagagaaaacattattccatgagaggaatatgagaaccaaaaaaa

SEQ ID NO: 264548 - DNA, 424 bp, Homo sapiens
gagaaggggtttcgccacgttggccaggctggtctcaaactcctgacctcaggtgatccgcccacctcggcgtcccaaagtgctgggattaccaccacccctggccaaaaactgttttatactttctataataatataaccaaattttgattactagagctatataattctttagaacactttgtgggcattatatttcttttccatatttataacaagagttttggactgttaatatgtgattccttacattgataaagcactttatgctaattcattagttacaaaacaactacgaactatgatctcagctttcaaggagtttgtagtgtagagataaatatgcagtatattaaaacaaaaaggctattgtgaggattataggagtttaatgctatgctgaagtgcctagcctaaataagtc

SEQ ID NO: 264549 - DNA, 381 bp, Homo sapiens
gttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaa

SEQ ID NO: 264550 - DNA, 406 bp, Homo sapiens
tttatgcaaaagaaacaaagtctctgtaatcagctcctcaagggcgggaactgtcagcatttacagtacctagcacatagcaggcactcggaaattctgctgacttaacagttacacacacacatacacacacatttttaaagagcagtgaatgcacactggggttttaactgacaaactagacattcagggggaaaattaattctactaatagcctaacttgcttggttaagttcttccccccacaaaaaacactgaataaagcattcgctttcttgttaatcgaaatgacacagaagcaagaaaactgaagatgagaatttgatttcactgcacaaatccttcagataagacaggaacagtgacactgggaacccatatgttaaaatgaaaactagatagatga

SEQ ID NO: 264551 - DNA, 618 bp, Homo sapiens
atgtttgcaaacgtggaagctgttgtgtagatgatgttcactcccgtgaatatgcagctgtgatgtggccaacagaagggaaggaacacgcctgtgtgctctacgtcttctgcaagccggcacagctccatgcgggaccagtgctgatgccagagtgaggtgtgggggctgtggcctgtgtctgcccgcacgtggtggcattctagcaaagccacgtgggtgggtgcagcatctccagccaccctggttgttaactgtcacagcttgacctgtgtccttgggtcaaaagttgcatctggtgcctcactcacttcctccattgttcaaagcagtaagagggttcagtctttggaaaggaagcatttactggctatttgaagagattgatttcagaaattgagcatcataactaaatctgattgttttgaaaggatttactacttttcattactttcatcccagtgttcaataaaaataggaaaagaaaggaaaggtgtccccagaaaggggcagccagcaccctggcttccagtaccttcagcagcgttgtcctgtggccatggattggcttgccgatgagcagtggttcctcccagactcctccctcagggcccttcc

SEQ ID NO: 264552 - DNA, 419 bp, Homo sapiens
cacgaggagaaccaggactggaggctcaatgatactgtcagtcccttgggactactcagccaacaaaaaattattgcggtttaatgaaagggaaattagcataaggaccttggctttaatactataagatcaaacccatagagcagtttttcatcatagaaaagttccacagagggtgaaagccttatgactacaaccttatatgaaatgcagtgtttataagaggctagaatattcattggggacatgaatctgatgggtgtgctgaacatggaatgagtgtcttcgctgtagcaaatatgacattctgctctgttatttccatatatgccttatctctcttatgactaagatagcttgaaggaggggatcatattcttgtatcttccaaagtgctgagcacacaactatgcacacgg

SEQ ID NO: 264553 - DNA, 401 bp, Homo sapiens
ctgggtgttgtgaaggatgtagagtgacccaggccaggcttcctgtccttcaggagctcatagttcaaataggactaaatgctattaaaaaaataatctagttactggtacagagagaatgtcccgtggactcattgaggatgaggaggtccagtcctgctggggtatctgagaaagcttcagaggcattggaattagaaccagatcttgaagggagtaaggattttgacagatggccagatggcactgagaacattctagtggtggggaagtgaagtgtgggatgtgtttaggtgaccccactggttgaaagcagaggagagggtcagctggggagctgggccttgaatgccaggccagtcctcagagctgtacagtcaccgcagagttgggagtggaga

SEQ ID NO: 264554 - DNA, 343 bp, Homo sapiens
ggagactcagaagagggaggttgggagggaagccagggataaaacactacatattggttacaatgtacattatttaggtgaggggtgcactaaaatctcagttcaccactaacaatttgtccatgtaacaaaaaaacacttgtatcccaaaagttattgaaatagaaattaaaaataaataaataaaaagaaagaaagaaaaacctgcagccaacaccatatatgcaggcagctcaaagttttcaccctaagatcaggagcgagggaaggatgcctacttttaccatttctgttcaacatagcactggaagtcctagccagagcaatcaggaaagaaaaagaa

SEQ ID NO: 264555 - DNA, 2181 bp, Homo sapiens
  misc_feature (1395)..(1395): n is a, c, g, or t
atcttttggagcttctcctttgtaaaatggacaggatgctgttttaagatttaagtgcttcttatgcaataggagctcaaagagtgggagctgttgtttattaaaaataacaatatcattatcatattctctacctaaagagacctgttgaaattggacagaaaaggaacgtttctgtcttgataagtcttaaaactccagtaccaagtgcagcattcgtttcttgtgagatatttgtagaatgggtggatagaaggatgggagaggagaggggtctgaagaattcctgtagcaagctaaagaggtatcatcttccaattgagctatttttagccttactcatcatttgtaatcaaaacaatccttttcttagccttactcctcccccacccctgcccccctactacttttgcgatggtaatcgtcattgccaacttactttctttggaatacacaaacagagctgtctctttccgtcatggagattttaacagtaaaaaactcactgcaccattacctctgccttgtattccagacaatagtaaaggacattgtaacatcactgtgtcagcgcaaacaaagaactatgtaattttatcccatattaatacagtgtcacgcaggaggtactatcattagatggcaatctataaaaatggcccctgagaccaggcactggcacaattatttattcttcaattatttattcagtcctaaggatggaaatgctgacagacactgcaaaatgctctacctatcaatttacagaaattgaatgacggaatcatttgtggactgaagtagctttttattgaccctatttttatttatttaaattctcactttcacagcttaactatgtttactacacccacttacatgatagaaatgagaggctgttttgttcataaaagctacttcaaaacaaattaatatttattctgaaagggtcagatcacaaatggaggctttaaaacggcctcaggaacattcaaatcgcatccttaatatttcatatggttttatatttagattggctattttatgtagtcttttttccctttttagtgctcatacctcttgagatcccttttctagccaggatggagggaacagttacacatagcttccatttgcagtaagtaatttcaacttaatttatgtcaggggagatttccagaaggttcccgctcctgtctgctattcttgtgattctaatatattatttgtacatgataaaatacaattcccattaattcacacttaattaagtcataaaagaatttgtttggtcttaactcctaaagtttaaaagattatttgcatttgtattaatactggagtttaaaaattatggctttctttatagatcagttccgattttccctaaatcanttattttcagttttgatttttcaaacacttgggtgagatccaatttatctcaccttctgatagttttaaaagagaagtaattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacacacacacacacacacacacacacacacacacacacacacacgaaatttatgatgtcctttaagaatcttgggactatcagaaaaaagttaagtgaaataacaattttcaaaaatacatttttgtagtaaaaacgcaccatcggtgttacattactgtataaatcaaatttgctgaagtttataaatatttttatgtttactttaaacttggacataatcagatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaa

SEQ ID NO: 264556 - DNA, 419 bp, Homo sapiens
cccccatcttctaaatatgcacccactatatgcaaattttttacgcttgcaggtaacggtccggcattcccggttctcttactaaactaaattttcggcccgcttcgacatcatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaa

SEQ ID NO: 264557 - DNA, 1729 bp, Homo sapiens
  misc_feature (15)..(15): n is a, c, g, or t
  misc_feature (943)..(943): n is a, c, g, or t
ctcggtaccctcgtnttttgatagggtcattgccaacttactttctttggaatacacaaacagagctgtctctttccgtcatggagattttaacagtaaaaaactcactgcaccattacctctgccttgtattccagacaatagtaaaggacattgtaacatcactgtgtcagcgcaaacaaagaactatgtaattttatcccatattaatacagtgtcacgcaggaggtactatcattagatggcaatctataaaaatggcccctgagaccaggcactggcacaattatttattcttcaattatttattcagtcctaaggatggaaatgctgacagacactgcaaaatgctctacctatcaatttacagaaattgaatgacggaatcatttgtggactgaagtagctttttattgaccctatttttatttatttaaattctcactttcacagcttaactatgtttactacacccacttacatgatagaaatgagaggctgttttgttcataaaagctacttcaaaacaaattaatatttattctgaaagggtcagatcacaaatggaggctttatttagattggctattttatgtagtcttttttccctttttagtgctcatacctcttgagatcccttttctagccaggatggagggaacagttacacatagcttccatttgcagtaagtaatttcaacttaatttatgtcaggggagatttccagaaggttcccgctcctgtctgctattcttgtgattctaatatattatttgtacatgataaaatacaattcccattaattcacacttaattaagtcataaaagaatttgtttggtcttaactcctaaagtttaaaagattatttgcatttgtattaatactggagtttaaaaattatggctttctttatagatcagttccgattttccctaaatcanttattttcagttttgatttttcaaacacttgggtgagatccaatttatctcaccttctgatagttttaaaagagaagtaattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacacacacacacacacacacacacacacacacacacacacacacgaaatttatgatgtcctttaagaatcttgggactatcagaaaaaagttaagtgaaataacaattttcaaaaatacatttttgtagtaaaaacgcaccatcggtgttacattactgtataaatcaaatttgctgaagtttataaatatttttatgtttactttaaacttggacataatcagatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaa

SEQ ID NO: 264558 - DNA, 391 bp, Homo sapiens
  misc_feature (15)..(15): n is a, c, g, or t
  misc_feature (367)..(367): n is a, c, g, or t
  misc_feature (372)..(372): n is a, c, g, or t
ctcggtaccctcgtnttttgatagggtcattgccaacttactttctttggaatacacaaacagagctgtctctttccgtcatggagattttaacagtaaaaaactcactgcaccattacctctgccttgtattccagacaatagtaaaggacattgtaacatcactgtgtcagcgcaaacaaagaactatgtaattttatcccatattaatacagtgtcacgcaggaggtactatcattagatggcaatctataaaaatggcccctgagaccaggcactggcacaattatttattcttcaattatttattcagtcctaaggatggaaatgctgacagacactgcaaaatgctctacctatcaaaagncgagngtatactctagagtcggcc

SEQ ID NO: 264559 - DNA, 150 bp, Homo sapiens
cctgctctggtggtctcatccagcactttgagcatatttagaaggcacttgatcccaggcagcttgtctcgacttcattgctgcctccttcgtgatcttgtttagatcctgtgtggagcagatgattaagttaggtttgtttgggggtgt

SEQ ID NO: 264560 - DNA, 489 bp, Homo sapiens
gagatcgcgccactgcacttcatccagcctgctgacagggtgagactctctcaaaaagaaaatatgaaataggagcttcagtgcccacaaataaactcgtgctcattcatttaacatgttgtggtagaggctgtatggcccacaaaatttaaaatatttaccctctggcccctttcattaaaagctggctaattggctgggcacggtggctcacgcctgtaatcccagcactttgggaggccgagaagggccgatcacgaggtcaggagatagagaccatcctggctaacacggtgaaaccccgtctctactaaaaatacaaaaaattagccgggtgtggtggtgggtgcctgtagtcccagctactcaggaggctgaggcaggagaatggcatgaacccgggaggcggagctggcagtgagccaaaatcgcgccactgcactccatccagcctgggcgacagagcaagactcccgtctcaaaaaaaaa

SEQ ID NO: 264561 - DNA, 317 bp, Homo sapiens
  misc_feature (31)..(31): n is a, c, g, or t
gagcgatctagaggatcccggcactctagtncaaatgaagatgagatgtagcaacagatttaacgatgactttataaaactgttagaagaatggtaagatggacgtgtggatttgggttgattaaatcaggctttaggaaagaagcacattttcttcggagattggaaggtggataaatgaaaaaacccaagagtctgagttatattgacatgaattcgagaaaactccttccagatggatctattctgagaaggagagttattcaccatatttactcttccaatcaatatactgatctgtacgatttgaggggcaa

SEQ ID NO: 264562 - DNA, 440 bp, Homo sapiens
acttttaaattttgatcctgggtgacaggagaaatggaaatttagaagagaggttggtttcggagagaagatggaactttggttttgtcatgtcgaatttgaagtgatgaactgaattcaactgatgatagttggagatgtgggactagaaggggagtaagaagttaggactatagatacagtgtggagtgtcagggaccttggagagggagaatagaaagttagcacaagagaaagtacacagaaagcaaaactgagcgtagggcctgagcttggggcatcatggcactcgaagcactgtcataaaagcggaggtggaagaacatttcacaaagatgtgataggtgatagatcacacctagagccatcaattataatgaagatgagatgtagcaacagatttaacgatgactttataaaactgttagaagaatggtaag

SEQ ID NO: 264563 - DNA, 746 bp, Homo sapiens
tgtggacaaggtctccattgtctaagccactgtgagaattcaggtaaatcatggcccatcctgggacagttcctccacattcttgctactcaaagtgtgcttcatggactagtggcttcagcctcacccaggaacgtgttagaaacacagaatcgtgtcaccgccccagacctcctgatgcagaatcttcattttagtaagcgacccactgcccccgcgccccctgatgatttgggtgctcattaaagtttgagaagcactgttggagcttgccctgaagttgtagtgcgctcttacggatttcaaaccaaaaagcattacctctgtgaagccagtctggagcctggctagaccttctccaccacctcgggggcttcttatgttccagagtctaacactctggccagataccagggacctttcaccctcagaacctgtgctcacatgtggcagtgagcagtgcctgcacctcaaggcaccgcatcttcccagctacagtgggcctggctgctccagctgcgcccaacatgtgttagtaggggaattaaatacccctctcactcccagttttgtgtatttaaaaaatcctcggaagagagtggtatatgaggtttgaggcttatcagcagctgcagcagcacaggccacgtcgtagctgtgagtcatagacaagcatgcacactgtggctgcctgaggcctctgagctgccttcctcagtccttccctctgcagggcttgggcgtgg

SEQ ID NO: 264564 - DNA, 381 bp, Homo sapiens
ctattgctcctaacccagcttccataacattttccatggctaaacatccttagtagtaattcagctggattctgtaatttaccagttcctttactaaaaccatcactttagtttttaaaggccctgtcctgctcattttaatacttcagtctatattgctgaaatgggggtgtagttaaaaaaaaaacccatgaaagaaagaaagaaaaaagaagaaaaaagaaagaaagaaagaaaaagagaaagagaaagaaaagaaaagaaaaagaacgcttcagtcttacattggatagaaagccttttcctgcacttgccctggggcacgcatgaactatgattcctggggtgaggaggggaagtgaggatgattctctcataccc

SEQ ID NO: 264565 - DNA, 479 bp, Homo sapiens
caggcgcggtggctcacgcctgtaatcccagcactttgggaggccgaggcaggcggatcacgaggtcaggagatcgagaccatcctggcaaacacggtgaaaccccgtctctactaaaaatacaaaaaaaaaaaaaaattagccgggcgcggtggccggcgcctgtagtctcagctactcgcgaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaagtatttattccctaagcatattcattatatgcatttctaggtattttgttgcagggacgctttcagattatctgtcttcagaattgctagatacagaagttgaccactcccttttaatctttaaatcaaggacaggattgaggtcaatatcgctgtgtgctgtct

SEQ ID NO: 264566 - DNA, 479 bp, Homo sapiens
gacccggcgctgggcagttctcagtgaatgggtgaaattcaccccaaagaggcagaagaaaggagtgagggagggtcgtgggagccatcagcataggcaatagattgctggaaacttagtcttggtataaatttggtcatgtgtcaaaaagaaaatttcaattaaaaaaaaaaaaaaagacattgggccaggtgcagcggctcatgcctataatcccaaagtgttttgggagccgaggtgggagaattgcttgagcccaggcgtcccagaccagcctggggaacacagtgaaatcccatctccacaaaaaattaaaaaactagctgggtgtggtggggcatgtctttggtcccagggtcccagttacttgggaggctgaggcaaggagaatcgcttgagcccgagacttcgaggttgccgtgaactatgatcctgtcactgcactccagtctgggccagtgagtgagactccgtttcaa

SEQ ID NO: 264567 - DNA, 416 bp, Homo sapiens
agagaattgcacagtaaaattgagacttctggattctttttgaaattttggaaaacctggcgacataaggcctgcattctctgtgccaacaattgattggcattgaataggggctgctgccttcagctaaggcagtactgtccagtttgccgtagttcccaccaccccatattgtccccaaaaccaaagctaagaatcaattgcccctatcacagttgcactctgcctttgcatataagaaaaaatggaataggttgaatgctcatgttcctgttaaaaatgggtaaacagaagatatatggggagaagaacatgtttaaagaaagatggggaaaaacatatttctacttgtttaatatacaaataaagtgtgtacattgaaaaaaataaaaatgaaggtgccattatgaaacaaa

SEQ ID NO: 264568 - DNA, 703 bp, Homo sapiens
aaagttactacccaagcaattattcccttagccacccatcacatcccaagcacctactgctagccaggccactgctgggtcctggggtacagaggacagtctgcccctcacctgttactgtcttctcgcccccccagccatcctagtggtgtgaagtggtatctcactgaggttttcatttgcatttccctagtgtccaatggtgctgagcattttttcacgtgcttattgggcaccacctcttggctttgccaccttaagtctcggttttcatatctgtaaaatggggacaatgacagcacctgcctcacagactgtgatgagggctcagtgagataatgtcagggtcctgggacatttgctgcttgaagctgcaggctggggttagggtccttcctctgaaagctggtatgagggagggacatggagaaagctggaagcctggaggtttctgtgagccccaaacccatgtagacagggacaaacatcagtagcgagggagctgacttaccagcccagccctgggtgatttctgctggagctctgatgctctgctgttctgcggcaggccgagtgaccccgacatgtctacacagccccagtgaaatgcagatggcacacgttcaatgcagacaggctcagcccatcacatgggcttctaatttttctcatggggaattattgggcctctgccccttggctg

SEQ ID NO: 264569 - DNA, 648 bp, Homo sapiens
tgtcttgatagactttcctcttttggttttcctggatgcctagtgtctgaaaagtatcctttccatagagcactactgtttaagatcttaagtatttcatattgagctctttttttgtgttgtgtttgttcctttttttttttagtgggtttagtgctcatgcaaagtaccagattgaaggcgtggagactgaagtcctctctatatccacagaacaggtatggcacaggcagcggcagtgtagcttttccactgtcccaccaatgtgcctcagtcctagcctagggggaacacgtttaggataagagggctgttcagtctccatgcccttcaatccttggctactgtgctaagattgccaagaagggggcccagtctgtagttacctccacacctccaaagtagaccaaatcaaacacatccatttcatacaaattcaaaaaagctttaagatatcataatcccagcttatttttttaagtagctggtttaaccattaagatttattaactaaaatgggcaaaaatactagcaagaaattatttaagaccctgaagtaatagagactgtcaccatggctactccctaccgaaaatcaaattgtcacaacaaagctagaaaacgaacagatttttttaaacctcaaat

SEQ ID NO: 264570 - DNA, 466 bp, Homo sapiens
cctgggatgcctgagacccgtcagggagtctgtaagatcaaaatcatgcacaagtatcctcacacaatgcaaaatagccaaacggattttaatataacagagcatggaaagaccattgatacggttacagattcctcattgcagctaacctttgagaaactaccattttttgaatattagtgttgtatcgtagaaaaatatctatagctaaccataaagatttaaactacttctctccctgttccaactacttatctgtgagaggccagattttcttcatatacttgaaccaaaacaacatgtttgtaacatattgaatgcagaagcagatatgagaatgcagctgtattttattaagccaaatattaaagagatttgcgaatgtgaaagtgatgctcttttcgtgaaatttgttgaatttggaaaacatctttattttttaataaaacctatggtgttcatgata

SEQ ID NO: 264571 - DNA, 363 bp, Homo sapiens
agaacattgtctaaaatgtgaagaattaggaagagagttaattttcactctttctctatatttgttattccacactacttggttataaatgcttggatgttaaaatgactaaaactacatcatgtaagcttttcagaatttcattatttttcggctatatttagaaaatattattttatgtaatagtttttccagatatgaaatactcacatgtcttgtatttaaaatattgctgagtagttggaaaaattaggatggagacaccccaacaaaataagaacatgtcccaagtaaaacaagtccacctaaagttttacagaaaatatttattgtgatgagactaataaaatctttctgacattg

SEQ ID NO: 264572 - DNA, 381 bp, Homo sapiens
gtttccctttccttctgggtccacagctatcttatgtgccttaaagtaaggtattgcaggtatggagttcctgccactggcatgagtagcatgaatgtgtgctgcttctagatctggcaggtgaaaaccttccatgaattcctctacctgttctgtttccaccctgccagctcaatgttgggagtcattttccaaagaatggcaaggctctgatcattggagactcagaaaggtggagggatggcagaagggtgagggatgagaaattacctaataggcataatgtacactattcaggtgaagattccacgaaaagcctagactttactgcatgcaatatgttcatgtaacacaattgcatctgtatccctgtaatctctt

SEQ ID NO: 264573 - DNA, 412 bp, Homo sapiens
ggtaatccatccgccttggcctcccaaagtgctgggattacagacatgagccactggtgcccagcctcaagcatttttttaagcctcagaaaaaaagtacctatacagtggggaaaaacaacataattttatatgtacagtacatttttaactggaatatgcctgatttcttaggaagtattgtacagatatttggtaacacactgagtattttgagctgaattgattaactgataagatatatctttgaatatatatatttttctttcatcacatattccagttggatattcattttcaaacagcacccttgcaaagtctagacagatattccctctcctcattcttttttctaggtacacagtctgtctataaaccatgtaagacaaatactactagcattctattttgc

SEQ ID NO: 264574 - DNA, 912 bp, Homo sapiens
tggatattcttacgcaaaaggagaacttgacatcatgtacagaaattaactcaggccaggcaaggtggctcacctgtaatcccagcattttgggaggccaaggtgggcagatcatcaggtctggagatcgagaccatcctggccaacatggtgaaaccccgtctctacgaaaatacaaaggaaaagatttagccacgtgtggtggcacgcccctgtagtccagctactcaggaggttgaggcaggggaatcgcttgaacccaggaggcagaggttgcagtgagctgagattgcaccgttgtgctccagcctggtgacagagtgagactccgtgtcaaaaaaacaaaaacaaaaacaaaaaggccaggcatggtggctcacgcctgtaatcccagcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactc

SEQ ID NO: 264575 - DNA, 449 bp, Homo sapiens
gcagtattcgcttcattgtggtggtctggaaccaaacccacaatatcttcaaggtatggctgtaccttaaattgaataaggccacagagaataatccccattattttatgccctttagtaatgatatagcacctgcccatgcgttcccaccactctcctcatggtgacagttcatgccaaaataatctgagtaacatgtccctgcagagacagccgtggcatgagtggcagcaagccagggcttttcatgtgctcttttgacctcagcctctttattccattctgggcagacccaactagccgagagtaaagagacagaaagaaagcagagagcctctccatcggcccgtggtggtggactgggtgagggaaggagcctcctcctcaactcaaagaaacttctttcaaaagataagaacttcagcaccataggaaagttaaaaaagaaa

SEQ ID NO: 264576 - DNA, 495 bp, Homo sapiens
tcatggcttaatttgcacagttaaaaaaaataggaccaattcttttgctttatagccaaagaagaaggaataaatctaagaggaggaactggtcaaaaccatactcccacttgtcttcttgtatgacatcacagcctttcttacattgcatgtaatcacctgtccacttgtcaggctcctggactatgagcgctttgagggcagagaccacattttttttttttcctgagatggagtctcactctgtcgcccgggctggagtgcagtggcgcaatcttggctcactgcaatctccgcctcccgggttcaagcaattctcctgccttagcctcccgagtagctgggattacaggtgcccgccaccatgccctgtcatccccgtgcctggcatgatgtctgaaatgtattaggcatttaacaaatgtttattgaataaacaaatgacattttgtttatatgtcaataaaatgaataaattgattttgatgcaaattt

SEQ ID NO: 264577 - DNA, 778 bp, Homo sapiens
  misc_feature (618)..(618): n is a, c, g, or t
  misc_feature (681)..(681): n is a, c, g, or t
  misc_feature (694)..(694): n is a, c, g, or t
  misc_feature (763)..(763): n is a, c, g, or t
ggaggaaaaaacagcttaaagttatcagaatataacagaaaattattttttcaatgtacaccatatttaaagaaaagtaaaattgtagaagtaaaagatgtagtaactagaattttaaaaatcagtgaatgaatgtggcagcagattagtcataaaataagagagaattagtaaattagaagctgagccagaagaattcggaaaatagcacagagagaaaaaaatagatggaaaatataagaaagaggctaagagatataaatgaaagttagattatttaaaatacatttaacttcagcttggaaacagaaaaggccaaaaaatatttaaagagaaaacaagaacatacaacaggtccaaagaaaacatccatcaaattccaagtacgttaaagaaagataaatccaaacgttgaaatattttagtgaaattacagaaaataaaggacaaagagaaaacaatgccaagaatagctagagaaagacaatagtgagtatgagattgatatagaattataaagaccaagtaaagatatatcatgcaaatattaatctcaaaaaagttgatatcagataaatgttttggaagaagtaaatagagtcttgtaacatataaagnttttaactcatcagaatagtacgagctgattcatatattttgaaataccagccttagatgatnaagaaagatatcnaagactccttcaggatcatttctttagttctctaagaggcttctcttacatgtggagcgctggaacccnaagaggagtgcgcat

SEQ ID NO: 264578 - DNA, 412 bp, Homo sapiens
tcagttagactgaaaactacctggcagccaggccctccggtcgggactggtggtggtgcagatatgatgacaggctttggtaactattgccaaagcctgtctctgtcccaatagatcaccagttcagcaaagtcaggcctgaagcgaagggagtcttgtgagccctggactgaggagccttcccagcctttccgctcctgctggccacctgggcccacatggcctcagggtcttctgccacagggtccttacccctacagcttaacagctgttctttccttctggatggattctcacattttatggttggttgatcagtcagatgttggaattgggggtagagggattatagagttgtgtgtgctatttaagttttctgtaatcattgctaattaaatttgttgattctcca

SEQ ID NO: 264579 - DNA, 588 bp, Homo sapiens
ttttataagaatacttgttaatggttttcgagacggattctgtgctaattcttcttgtatcatgaatgatggccctagctagacactgtcgctgggatcttcatctgttaatcatggaggctgctttcttattcggttgccatagtttcagtgcctcacatagtgttggggtgtcttgggaaaggtttgagatatactagggcttgcaagccttgcagttattttgacagttgtgctctgaaagactgaaaaccgcttctcgtataattcagtgttggattaaaagaggcaacttctgagagtgtctccctggaccttgttatgtgcacatccagctggtatttaatccaggatttgcctcttgctcagtcttgctggcaaaaaaaataaataaataaaaatacagtacagaggctgatgtcactttcatatttcaacaagaaagcaaagggacgcaaactcttcattaagactattcacaaatgtggaggtaaatgaggccattcatgactttgcttaaaatttctgctccataatttggctttggctttgcagattactaaataaataaaatgacatcatgattgc

SEQ ID NO: 264580 - DNA, 450 bp, Homo sapiens
atacagctggataaaggaatatatatatataaagaattggctcatgcaagtgtggggactggcaagtccaaaatctgcacagtaggctggcaggctgaagacccagggaagagttacagttcaagtccaaaggaagtctgctggcagaattcctcttccttggaggaggtaaactttgttttttggagtcttttttgtaacttaatttgaggctttcaactgattggatgaggcccatctacattatgggggataatctgctttaaaatctaattttaatgtcaatattttggtaattatatgatataaatttgtcatataaataatgctatgtgtgtgtgtgtgtgtgtgtgtgtgtgtgtatatatatatatatatgcagacacacatatgcacatgtatatatatttagagacaggatctcattctgtcacccaagctagagtgcag

SEQ ID NO: 264581 - DNA, 428 bp, Homo sapiens
agtgctaaccagaaaaaaaagagcaaggaagtgaaagggtgggtgagttgttattcatctagagtgattacagcagcctcatgagtaaagacctgaaagaaggagggagccattttggatacctaagcatttcaagttggggacacagtggaaggatatcctggtgtatctgaagagactatgcaggcccttgcacaccactctgagactttgactttcattctgattgaaaagggaagctctcaacaggttttaaacgtaaaaaaggaacaacctaatttttcaactttatttttaatagctttcttgaagtataatggacatataaactgcaaatatttgaagtgtacaatttgataagttttgacatatgtatatacccatgataccatcatcaccataaaaataataaacatatccacatctca

SEQ ID NO: 264582 - DNA, 630 bp, Homo sapiens
gggaaaacagttctagaataactgctccgtgttcagggggagaacagcggtgacgtgggtgccccgttgtcttcatccaccgtgacatcagcaaggagcagagaggaagtggccccggacccgcggccggcagctagacaaatgcactgctgggactgccatgcccagcacgggccgctcccctggggctctgcgcgtagagccgactccttgcttgtacctgcctgccttccggcctgcaccgggcaagaaacgtggggaggggatccacaggccaaggcgccgcacagtgatgccctgctccatcccatgacagggcctggaaggggactggcagctgcagaaatggtttccggccttcccacatcccccacgcacttcccggtgggggcatttttaaagtcgaaggagacacattcattcaaatatgtattaagtgcctgccagtggctctgagaatagaacagtgagctagactcttggcatcgtttcctagggagtcctcggtcctagggggaggagagagccctgtgtaatgatttcagatgatgttataaggtagggtgtggggcgggcgcggttgctcacgcctgtaatcccagcactttgtgaggctgacggaggaggagg

SEQ ID NO: 264583 - DNA, 546 bp, Homo sapiens
gaaaatactgggggaaagcaagccagcaaccgaaactctaacagatttcaggagacagacgagtacgggtgctccaggcaggggcagccctggctgtctgtttctaatccatgccaactttcaggccctgccagccgcacagcctccgagctggcaacaatcagccctccctgcctccacctcccgccctacccaaccccggcacactctgctcttcctccaacagggaactgaagccccacatctttccagagcttcccagacttggacacacatcctggccctcctctgaagccctgcaagatgtatcgagcctgccagccaaagatgaccacagagagcctctccgtgggtgtacagactgaatcgtgcctccaaaagatgttaaagtccctacccccagtactgcgactgtggcctgacttggaagtagggtctcctcttcgaagatgatagtgttaaggtggagttatcagggtgggcccccacccatcactggaaatcccatccaaggggagatgtggtcacaggcaggacacacacaga

SEQ ID NO: 264584 - DNA, 438 bp, Homo sapiens
ccaggctgctcctgggctgtagcctcatcagcaattgcctggagtggctccgcccgagcctgcagggccaccaggagaatggcagcaaggagggcaaggctccttatggctggggtcacctggaggagagagagcaggagcggatgtgtggggagggaggagtctgcctagatttatagctgggagaaggctcagagacaaaccttcttgaaccttctcagtgagaggaggtggagattcgttggagagggtgtggatatccattggcttcaatgttcctcctttccttctctgctctcccagctttcattctagcatgcatctctatgttgagtgtcttggctgggttggagctgatggtgatgatgaggaccctgccatgatgatgtgctttcattcagtgaattcagggaataaaggcctcttactttctgaaga

SEQ ID NO: 264585 - DNA, 438 bp, Homo sapiens
accatcatgtgcactgaaatatgtataatgggaatcccagaaggaaaggagagaggaatagaggcagaaaaaatatttgaagaaataatcactgaaaacctcccaaatttgatgagagacaatttgcagattcaagaagcttaacaaaatccaaataaaataaacacaaaagttccacatatagacacaacatagtcacattgttaaaagacaaagacaaaaaatcttgaaagcaacaagagatcaacaactaatgtagagggcagtagcaatagtattaacagttagcttatcagaaatagtggagtccagaagacagtggaatgacatattcagtgaaagtcaacaaaatggccaaccaagaattacaaatttaataagattatcttccaaagatgaaggtgtaaaaaaccattaccagagaaacaaaaaggaaaa

SEQ ID NO: 264586 - DNA, 458 bp, Homo sapiens
tgagctgagattgtaccactgcactccagcctggatgagagtgagaccctgtcttaaaaaaaaaaaacaaaaaactattcactaaaaggacccacagaattcactgagagatgttatgctcatggttacagtttattacaaggaaaggatacagattgtcatcacccaaggaaagaagtacgtggccaggtgtggtggctcatgcctgtaatcccaacgctttgggaggacaaggagggcagatcacgaggtcgggagtttgagaccagcctggccaacatggtgaaaccccatctctactaaaaatacaaaaattagctggacatggtggcatgtgcctatagtcccagctactcaggaggctgaggagaatcgcttgaacccgggaggcagaggttgtggtaggccgagatcgtgccactgcactccagcctgggcaacagagtgagactccgttc

SEQ ID NO: 264587 - DNA, 143 bp, Homo sapiens
gggagcttctaattagaaagaccccgttgtctggttactattatacactcactctgtctctgacgcatgtaggctattgctcctcaggaggtaatagctttctcatacttgtctataaaaaataagtaatggaaagaaaattc

SEQ ID NO: 264588 - DNA, 400 bp, Homo sapiens
tcattcacttctcatgtggttctaccttagacaacgatttttgtttacagagacaaatagaagtatctaatcctaaataacccaatcaattggtaaaggctacactacaaagctggcatgacttcaccaaatgctagagaaacagtgttaagagtgacaacactaaaagtcttacactctgatgatgctagttgccgccgaattgcttcccctaccagttccttaagtttcttcttatgatcccggctggttttcttatagaaataaagatctttttccaactgctggattttatcttcatatgttttgaaagtttccataatgccttctccatcttgttctatacaacaaaaatttgcatttaaaatcagttttaaataaatgatgcaaaattatgttt

SEQ ID NO: 264589 - DNA, 425 bp, Homo sapiens
gcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgagcaataagagcaaaactctgtctcaa

SEQ ID NO: 264590 - DNA, 738 bp, Homo sapiens
  misc_feature (12)..(12): n is a, c, g, or t
agcgggttgccnacccccatgtgcagcactgtctggactctagaagatgctctgattcaagaggatgtaaagaaattctctaagccgataagaaaaatagaagaaacccaaatgggcaatgagtgcatgggaactcactcacctcagtggaaaggagggaatggcaagccagcccactgaagcccactggggacataggacaagtccgcaaagcagagacagcccctccaggaagagcgaccaggccttgagaggacatggccttaggaccagatccagggaagacacagtcactaacccctggctcatctggcaggtgtgggaagcagccaggcccgtggcttcaccagctccccccgatctctgccttcagctgtcctgcagcctgggtcaggcacctaggcagctttatggcaggcggagatgcaccacccacatcctctttccaggcagggcttgctgccctggctgtagcgagtgcggcagcaggtggcctccagctatcagcaacttcagagagctgccttgcctgaggtcccgtcccttctggggaagctcccatctgccagggggctacaaaagcacagtggacaccatgatgggcaattctggctgatgggagcaccacctggtggctgaggcattcttgggccacatagcagttgactgccctctccaccatcttttcacaagtgttaatcccaataaacacccatcctcttccatcccaaaaagtct

SEQ ID NO: 264591 - DNA, 379 bp, Homo sapiens
caatgtaaagtatagactttgggtgctaacgatgcatcaatatgggttcatacagttttatgacataatttaaagaaacataaaaaagtatttggttataatagtgataataacagtaaaagataaaaccagttataatatagaatgttaactgtaagtaaaattgtattaaatataggataatatgaatatatagaacaatatttagaggaaaagagaacatcatttataccgaatttttaagggaaatcagtagaggaaatttcaggacatgagacttctgttgtgcatgctgctttgtcagcttcctttaagaccctgaattatttatctacactgggcaagggatgtcgagtacctcggccgcgaccacgcttta

SEQ ID NO: 264592 - DNA, 454 bp, Homo sapiens
cctttttttttttttttctaagacagaatcttgttctgttgcccaggctggagtacagtggtgtcatctcaactcactgcaacctccgcctcccaggtttaagcaattctcctgcttcaccctcctgagtagctgggattacaggcacctgccaccacacctggctaatttttgtattttagtagagaaggggtttcactctgttggccaggctggtcttgaactcctgacctcgtgatcacctgccttggtctccggaagtactgggattacaggtgcgagccccgagcctggccagggctgcaccttttatctaaggctctgacacagcaaactgcagcctcctctgtccaagtcaagttcggagatcccaaggctgggggcaggctccacatgtgtcctggaatcaccaggactctgctgctatcaaaggcctgacgtcaagaattggaag

SEQ ID NO: 264593 - DNA, 511 bp, Homo sapiens
tgcctggcttccagtgactgtccgagatgacctgtggagtgcaccgcctgtacttggacatcactgtcttttccgatccatacccgtcatccttggaatttcccctgcatccaaacctgttcctgatacaggtataaccctaaggaatatcttggatgtcttcacggggcttatgacttattctgaggtttacaaaatagaggcccccagctgagcaaagagagggctgcagcgccgagggaacagctgccggactcaccggagaggcctcctggagcacgccgggaccccctccaccccctggctttggctgcatccatggctagtttgcctgaactatatctgagccactgagagtatttattaagcagagaataattttgagtttcacttttataacttttgtttcaaaagttgttttggataatttaatgaaatgactgtaaaccagaattccccttttcattatttctttgtgtcgatataaaaagagttgatgattttaaaagcc

SEQ ID NO: 264594 - DNA, 803 bp, Homo sapiens
cgcaccagggctctggtgaacagcaaatgctccacgctgggacgggccattgcctgatgcctgtacatggtgggcactgagagacaagattcctgggccctgccttccatacactccccacgatctcggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacacca

SEQ ID NO: 264595 - DNA, 1031 bp, Homo sapiens
cgcaccagggctctggtgaacagcaaatgctccacgctgggacgggccattgcctgatgcctgtacatggtgggcactgagagacaagattcctgggccctgccttccatacactccccacgatctcggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagaggtgagggcactgggcaggatgacagaaaccctgtccctcggcagggaccggcactgctcccacctgtgcccaaggccaaccactccctattaaggctggtgctgagaaaaagaaattcagatgaatgctctgtctagaataaccaatgtgaccaaagaaaggaatggattttctttatgtcactcctagaagggaggattacgatgcattttatcccagaagttgatgcacaggcagagttgtctactgagtaggtattcagtacatatttgtttaattaaatatctgtttcactgaga

SEQ ID NO: 264596 - DNA, 628 bp, Homo sapiens
ggggtgggatgaaggagggagattgttttaataagcacatgctgatgggggctgctctgtggaccagccttgctctgtctcaggggttcagccttctcttcctgaggctgtcctactgattcctctggagttgcagcaactcctaccctgacctgatccatgggtcagaatcagggtcaggatgagtcaaggctgactcattgactatccactctaatggcccttcctccccagggctctatggatgctgacctttgtcctcttccaaactaaagaaaaacaaataagcatacaagcacaaaaccagccccttggacttcctgctaatcctatttggttatttaagtgtggcaggtaccttctctcctcagggcctttgcatatgtttctactccttcctcctgggcttctcttcgcagttctcattctcagtcccatttactgttgggcgagttcctaatcacctttcatacctgcatgtaaatgttacctcttcagggaagccttccctgattatcctccactccagtctctaagttccccgtcctgtactccaacagccacctgtctgccttttgtatcacttaatcagaattttaattaaatgattatgagtataatgatttaa

SEQ ID NO: 264597 - DNA, 491 bp, Homo sapiens
ggaagccggccgggtggaaggggagagggccgttatcgtggtgcgaatccaactcgcagcctctgggagcacgttgctaataaaggtcaaattaaaacaactaagtggtgccggcagggacgcgccgcatggtcaggagaagcccggctattaatcatccataaggagcattgctcttctggtgtgggagaatggggctgtgcgacagccccccggagttgcgctctgctctgaaccctaagctcccccagagcaagtggattgcgcagcctattaccccacctccccacggccccctcttggggcggcaccaccctagatggcaggaattcggagaaaatgcggtgtcacgtccgccgctatgcccgcacacgcgtctgcgccaactccagcaacacgtggggaccgtgaatctgggcgtctgctctccacttaggtggttatgtgggtatacttatatgattactgattaaaaccaaattggacggaga

SEQ ID NO: 264598 - DNA, 254 bp, Homo sapiens
tgtatattactcaaaataaagtttctttcacttaaaaaaaaaagcctctttttcaaagaggcttgacgtcaagctgaaactatcagtgagtggaagtaaaagcaaaaagtggggaatccttgaatttagcaaatacatctctgaagcttctcccccgaagttgggcccaagcaatgggaatgagaaaggtaactgtagccaggtgcgtttcttcaccccagtctttggcaggggatggggaggtggattcttaa

SEQ ID NO: 264599 - DNA, 363 bp, Homo sapiens
gtcgtgctgggcgggtgtcggaggcggcgttggagagatgagccagagggtggccctggacgccaaaccgccctgcagtcctccgagctgcgctttgagggctgttgagagaggggtggaaggtggaggtgcgatttttgcctcggcatctagagaggcgaaggagcagccctgggctccgctgctgactgtggccatgggccgttaacctcatcaaagcccagtttcctcctgttgtagatgggagaggaacagtttttgaactgcgtagaacctcggcaagtcttagcgctgcatttgtgttttctaagctgtaattctagttattgctacttttgacttgtggaatgtggctcctccctg

SEQ ID NO: 264600 - DNA, 440 bp, Homo sapiens
cttctatcctcaagtaggccccaattgtttattattttgaatggaactttttatcttgagataattctagatttatacagagttaaaataaataataatattgacctgatgtaccatttacctcatttcctccaatggcaatatcttccaaaattatagtacaattttacaactggggtattgatgttgatacagtcaaggtaccaaatattttcatcaccacaggatctaccatgtccttttatagctacccccacttcccttccacccctacacctttcttaactcctgtcaaccgctaattaaaaaatcaatttttagcagagaaaattttatgtgcaatcctgagaagttctgtattaaagatccacatggccttatgaaaagagcccttgggccgggcgcggttgctcacaagtgtaatcccagcacttgggagg

SEQ ID NO: 264601 - DNA, 532 bp, Homo sapiens
caatatctttagtatgaagactaaaagataaagctaccaaaaatgacaacaatttgtcaggagatgggcaatataaaatgatgtaaattgtggcaacaaaaagtcaaaatatgggaggcatggagtaaaagtgcagagttttaaacttttttttattggcttcctttctttgtgctgaatgttaagtttccatcagtttaaagtaacttgttatagctctaagatttttttgtaagcctcatagtaaccacaaaatgaaagtttgtcatagatatactaaaaataaaaaaagagtaattaaaacatactcccagagaaaatcagttaaccacaaaggaagatgggaaggaagaagaacagaattaaaaacaaccaaacctgggcatgatggcatgtaccgacagtcccagatactcaggaggctgaggcaggaggatcacttgagcccaggagttaaaggattcagttagctatgatcacaccaatgcattccaaacttgttgacagacagagaccttgtccaaaaaaaaaa

SEQ ID NO: 264602 - DNA, 333 bp, Homo sapiens
agcttgggtgacagaaccagactctctcaaaaaaagaatgtacttgttgaagcagtacaaattgttaatggcatttaattctgatatttgagtatgtatctttttaatattctctgcgatgaaatgggaaatactcataagcacttctactgtacaacaaaatatgatagttatcttgagaagatgtgcaatgatttgacttgcgaactgaggcagctgcttttttcatggaccactatttttaccggcaaagaaaactaacaaactacagtcatccaaacttgggtattttccagacattttctcaaataggaacaaagtcagcttgtcact

SEQ ID NO: 264603 - DNA, 468 bp, Homo sapiens
gatcattgggataattgagaggagaaacagagaaagtcctagatttagggccacagtttgggtgctagttctggctctgatgcgtaatgtttatgggatcttgggccaagaagtcacctttgtgaacctgttttatttgtgtgattaaggaaatgctgacaatagtgctatcacttagaaaatatgaaactgtaagcaaacatttatctgccttcatattttgtcacgtaagtttattcattccataggggagccagtggtttttggtcatgggaagtgttctcataaaattcattttagcttgtaaagtttaaaatcgtcaaagataaactgaaattgtaataaaaattgataatgcctcttgatagcttaccaaatatcggacactttacatattacttttaccctaatctttataataaccctttgaagccaggtactgctatttttactatcatacagataaca

SEQ ID NO: 264604 - DNA, 316 bp, Homo sapiens
agtggaagagatggacatacaattgcttgatgccagttatgtattgtatcagttacctggtgtggtacccagcatgtagtaggagctcagtatatgcgtgaagaataaagaataagtgaacaaataaataaattaattaatgattatagttcttccaaaatagctctgtattcagagcctccatgtctttgaatatgctagtccatctaataaattcctcttttcccttctccacctttttccaagttcacctggcaaactcctgtacttcttgagacctgaaaaatttgtgttacaccaaaacaaagcctgctca

SEQ ID NO: 264605 - DNA, 555 bp, Homo sapiens
accagctatggcaatagcttctatttttcaaagatggctacaacaatatcccctgtttcaggcactcatttacaacgtggccttgatattcctcctactgagaagtcagtctatgtcctctctctttcatgctggacaggcttgtgactcattggaaaccagtatatagaggtgagaatgatgctgcacaacttgtgagactaggtcagaaaaagcagtgcagcttttgctttgtgtttggggacacttgcctttggaagcctgagctgacatgtaagtcctactgtcctgaggccgccatgctaggaggaagcccagactgtatgaagaggccacatggaggtgctgaggttgacagcctcaactgagggcccagctgattgccagcagcaactaccagattgagtgaagaggcttctagatggttccctgtgtttgatttttcctagctgaggcattggacattgtggtgtagtgacaaaccactctgctttgctctgtctgaattcaggacccacgggacccatggaataatgaaatagttattttgaaaaa

SEQ ID NO: 264606 - DNA, 618 bp, Homo sapiens
aatttgggtggcttattacctactgttatgtatcttttaaagatccagtgatccaaaaagctgtgctttgcccaaaattccaaaatgagaaaaccataaaaaccaccctctagtttctggagccattttcaaatctgtgttgattctgaaggaatttcatttacgtagcattttcacatgttaacagtccttcccctaagggattatgggtagaggaaagaagatgaggtggtaaggaggcactggaggagatgaagtctgatttgtttagaaaggaccgatggaggagtgtagcagacactccttttgttctttgctcctgctttaatccttcagacccacaggacaagattgccagctaattgcaaggagcccgtaaaagagaattggcctaaattgaagaataaatatatattttttttaattcttcctttatttgggtcactttgctttacatatgtttatgtctccaaaaagtggttggataccctcttgagaggttttctttacaaaaaagaaagaaaaaaaaatctgaaattccaaagcctctttccctgccattgtagcacttaggcaaaagcatgaagaactaaatccactagactgtagtttaaactt

SEQ ID NO: 264607 - DNA, 654 bp, Homo sapiens
gagaaatttaacagtggtatgaaatgacctatagtgtcaggtgctgtacagaggccagcatggatgaggatcatgccaaagctgtaagactgaccattaggagaattttggtgtcagttaaaagagaagtggtacagataagagtaaatgcaaaggaatacaagcaaaaactaaaggatactttttgcagcagtttgggaatacaacaaagggacttagaataatatggtcaggatgaggtttttcagggtagatgcatcatttaggttttgctgtataacaaacactctaaagtggcttaagacaataattattattatagctcacatgtctgagggttggctcctcccagctgggcttgctcatacatcagcagacctactgggagctttgctctaggctggacacttacctatcatcctccttctgtgactgtccagctcacttaggcatatctttctcatgaagatggaagaagtgttgaagagggcaaacagaggctgggcgcggtggctcacacctataatcccagcactttaggaggccgaggcgggcggatcacctgaggtcaggagttcgagaccagcctggccaaaatggtaaaaccccgtctctactaaaaatacaaaacgtagccgggtgtggtggcacatg

SEQ ID NO: 264608 - DNA, 460 bp, Homo sapiens
aaagcaaatttgatagaccatagcaaaaagacatgttacatttgattattctcttatttgaaaagtacgcttttctacattttcctaggtaaccctgtttcagaaccatgggccctctggaagttaaaatcactctggaggtctcactggttgctctgacagcttcttcctcccgataaccggctttcctcatctcaaggcacattccaaactgccgcccggtggttgaaacagggaataaaccaaagaaaaaatactgttctcttcctttctctaggaaattatgcttgtggcattttctccctctgtttccattaccctaggataatctctctttcttctgcacatcagtactcagtgcagaagacaagggttgtaatctttgtcccccttctcacctgcctcttgcctagtcacactcactaaatctctcaagccatgtctttatatagtttgcttt

SEQ ID NO: 264609 - DNA, 407 bp, Homo sapiens
gaagacagtagccagatgggccaagggccccagccacccacgcccctccctctccttgaagaccttcggttccaaccccaccatcagcagggctctgctcagttcctccttatgtgtatcaccacagggctgctggctcgtgtcacgttcaccaccagaccccacatcaggagtcccgccaggggtgtggggaggcagcgctgcctggttggccgtggagccgtatggaacatggtgcctcacaggcagtctgcttggcgtcctggatcctggctgtatcccgctggaaaggatgtgtgtgggtctaagatatgtatataatagaaacatttattcagaagctttagtcaagacttcatttttaagttcagagtaataaactcatagtctaaatttaaaaaaaaaaa

SEQ ID NO: 264610 - DNA, 362 bp, Homo sapiens
cacttgatttcaccacttcacacccacgaggatggctaaaataataataacaaaagcatggatgtagagaattgaaaccctcatacaaggctggtagaactgtaaaatggtattaagtgctttggaaaacagttttgcagaccatgaaaatgttaaatatgacccagcaatttcacccctaagcacatacccaagacaactaaaaatgtgaagttcacacaaaaactcatgcacaagtattcatagcggcattattcacaatggccaaaagaggaaacggcccaaatgtccctcaaccaataagtgaatgaaaatgtgacatatccaactataaaaatggaatggaatattactcaactata

SEQ ID NO: 264611 - DNA, 445 bp, Homo sapiens
tgttttcagatgattatttcagaggatctgactgctcttcatcttcatgaataactttaaatacattaatccagttagcctcacaacaaccctcattttacagactaggaaacttttgtcagtcatgctgaattactttctcaggctctcacagctagtatctaaactcaggtgtgcctgtctcacacttatattctctacacaatagtaaacagcaggatttgtagaaatgtaggctagagaaattgtaatttgtattaattacatgattgtcatttgttaaaacctcagctgcttcacagatgatttcttagagaaaagtatactatgacagtaaacacaatgtgtttccgaggttcataagactgtgaaatgataccaggtgactgttggtttccgtcattacaatattgtacattaaaatgaaaacatataagtgaagtta

SEQ ID NO: 264612 - DNA, 434 bp, Homo sapiens
gaatatattttgcattttgtaaatcagtatgcctattaggggcacccaattaaaaaaaagtcaagcattctagagaaatggtgtattagtctgttctcacactgctgataaagacataccagagactagaaaatttataaagaaaaagaggctcaagggacttatggttccatgtggctggggaggactcacaatcagggcagaaggcaaaggaggagcaaagtcatgtgttacattgtggcaggcaagacaaagagcatgtgcaggggaacccccctttataaaaccatcagatctcatgagacttattcactatcatgagaacagcacaggaaagaccctcccttatgattcaattacctcccatatccaaattatggggagctacaatttgagatttggggtgggacacagccaaaccatatcaaatggtt

SEQ ID NO: 264613 - DNA, 432 bp, Homo sapiens
cacagggcctaggtgtcccaggagcccaggcgctgcagccctaggggacaaaggggaggaggaggcgaaagaagtcgggaatgattctcctatcctaccaacccgtgtgatggaccctggaccacaagaagaggaagcagttaggggcagtggagtcaccctggggttgactgcactcatcatccacaggatgtgcacacttacttcacagacactcttctgcagtctcaaaatctcacccatcaactatgacccctcctacctgctgccccaacaacatatttaatcagcagctaacactatgtagccccagggggttgcagcgcctgggttcttagggggatcccaggtccccaaaaggagtttagaatccaaactgaagagagcagacaagcacatgagaaatgcgaataaaactaaccacatctaagg

SEQ ID NO: 264614 - DNA, 399 bp, Homo sapiens
atcttgaggcactgaaggagcatggggggaggggaacggaaaggacaaagattctcctatcctaccaacccgtgtgatggaccctggaccacaagaagaggaagcagttaggggcagtggagtcaccctggggttgactgcactcatcatccacaggatgtgcacacttacttcacagacactcttctgcagtctcaaaatctcacccatcaactatgacccctcctacctgctgccccaacaacatatttaatcagcagctaacactatgtagccccagggggttgcagcgcctgggttcttagggggatcccaggtccccaaaaggagtttagaatccaaactgaagagagcagacaagcacatgagaaatgcgaataaaactaaccacatctaagg

SEQ ID NO: 264615 - DNA, 567 bp, Homo sapiens
aaaaaagacccatttgccaaatcagtggcagcctccagtgtgcctgagaccaagctagctggctctaattcagatccaacttctgacccagcagctacaattgaaataacacctttgcaggagtccactatcatcccgcaggatgcatctagactttggaggaggcagatgagagaattaagtggagtcatggtcaagaatcgcgcttttaggcctttaagggtagcactagtctctactgtccccccagggacacagtattaatttagttaaccatgttggctgtcgggaggtggcaatttcaagagctttctcttggtcttacccactacactcgctcttacttcacaaaccaaagaaccaacgtgggtgctcagtgacttgccaagtatacccactcaaattgtacatttggactggagaagtggccactaggttcttctgtggaccccatggaaacatagtgagccagactcgatttattacctggtaactcaggtcccaaatctaccggcaggaacatgtcaacccttcaggtcttaaatatcaatgatatgttggacccta

SEQ ID NO: 264616 - DNA, 481 bp, Homo sapiens
tccaaaaattttaagtggaaaattctagaaataacttaaaagcacaatcccacctggggcaggaatcatctgtttgttcagcatctccacactgtaaatgctacccaccagttagtcacttagtagctgtcttggttatcagattgactgtcaaggtaatcagtattgcggtgcttgtgttcaggtcacccttatttaataacggccccaaagcacaagtgtagtggtgctggcagtttggatatactaaagagaaagtcataaagtgcttcctttaaatgaaaaggtgagagttcttgactttaaggaggaaaaaaatatatgctaaggttgctaagatatatggtaagaaggaatcttcgaaccacaaaattgttaagggaaaaaattcattttagtttttttttttttttatgctgaggttgctaagatacatggtaagaaggaatcttctatccacaaaattgttaagaaggaaaaa

SEQ ID NO: 264617 - DNA, 936 bp, Homo sapiens
cttcatcgtctctcctggaccccctgtgacggttcctgttttcctcccgaccccctctgccggtgttttccgaacacctcgcttgtcccccggggcgtttttttcttggggggaatacccccgccctttgttctggccccgcggtcttcctccggacccccccgcggtgcccccgtttcactttgcctctgtgcggcccgtccgcccaccacgctcagtgtgttctcaaagaactttttttcgaggcccgactgcggcccacacagtggttttttttgtctgtgtatgtctctgtgttttttaaactgatgaggacacttaagaatcccttcttagactccattcaagctgtgagggatatatgccttgtttacttctccccacaataaaagtgacaccaagaactaggttcacagacagctagaagatatacagtttgtttcatatcactgaaaaaaatgaaaaaaaaatgtgggttttggtgctactattaggttaaactatataagactgcctctaacgaattgttcaacctaatacatgtggtacattgcttccctgaggaaggattttatcctttatagactgtttgacctctgatgtcccactagctgagaatctccattgtctaaaaaactgatttgttcctcactggaggatatactgaaccaaagggtctcctatgagaaaactgcatacagcatatttgaactatttatttcagtaggtcttccatgatgaataaaggaaacatttaaaaaaattgagatcataaaaaaattttaataaatgaaacaattataaatagacttgtggactcttttaagtagagagtgaatggtctgccctaaaaaaagtaaataaaaacaaaaaaagacaagaaatgaactgaaatacttcaagaacctcagaagttaattccaatttactttcctc

SEQ ID NO: 264618 - DNA, 674 bp, Homo sapiens
caattatcatgttaacacatgattcatagcatatatgtttgcaaataccctcaatactaatatgttatttcttccgtatgaggtttaacattccaggctaagtgtttaaaaatatataaaagaagtaatagggaaaacatatgttcacacaccttgctttgcatgacaattcattaaagaagaagaaatataaccaaataacgtcaatctggctggtgttaaatattatttgctgtgtaacaatcaaccacaggagaaaaatatttgaatatttagaccggcagttttaatcctgcaagatagatgtgttgttagaaaaacacctgttgctaatgtttccaattaatgtcactttacagtagatctttatgagtccaaacataacacctttctcttgccttatgcttatttaataccacaaaaccaaagataggcaatgttaaccttgatttacaagttcttctctaacgcttgaaatggacattttctgattcttttctttcctttttttctatcacttccctttctttctcttctcttcctctctctactttctctttcttacctccctcctcctttcatctccttccttccctttctcagtttctctctcctcttccttttcttttttttaattattttaaataaatcagccaggtcaacttaaaatttct

SEQ ID NO: 264619 - DNA, 379 bp, Homo sapiens
ctttacctataacctatttcagcccccttatttatagtctactttcccatataaaactaagatttatatataggggtgtttgggggtatgcaaatgaatatataacatatatgcatacacatatatatacattctcttcatttcttttatatgtataggtatatactcatagaattttgataagataataaattttaaccctttgattacatatgaaaaatttgaggaccagagaaaataaatgactttttcaagattatattctttataatcagtactggaggcaaagccagaatgctgccattttaattccaatctgttattttcactaaatcatgtatccttttttataatgaaaattaaaatgcttacataatta

SEQ ID NO: 264620 - DNA, 445 bp, Homo sapiens
atttagctcagagcccagaggggaacagggagtgacaagtcacacctgggctctgaggagggagtcgtcccagagcaggggatgcagggattctggctctccccacccatctccctcccagagacaggggagatgtggggttggtcaagccctcggcccccattgatcccctgtacgactgggattcccaaggtgcccgtctccctcagacactagaggcctggtaccctctaagaagggggccacaagccctcttcccatcatctgactgccctgccttccagctctggggagggttggagccctcttgggggcaggagggacaggggtccaactgaggaagggaagagggcacctgggcacgcgtggtccccggaaagtggccctggggggaaccccgcccgcagacacccctccctgtgaaggatgtaaaaaaaaaaaaaac

SEQ ID NO: 264621 - DNA, 457 bp, Homo sapiens
catggctgcagcttcaggccaagcccaatggacccaggctccaagtctttcccatggacctatgcatcaagttgacctttgtgaacctaggcatcagacctgttcatctgctaacttaggcaccaagccagctcacctgaggacttcagtagcaaacctgtcatggaccttgcatgtcagactgccaagaatctctgcccagtctgactgtaaagggatctccctgccaaaacctgtctctaacaactagaagaggtccttactttttaaaatctgcagacagcagttcaagaccacaagattacaaataatctgggaaatgtgacaccaccaaaggaacagaataaagcaccagtaaaccaacactaaagaaatgaagatctacaaacttcctgaaaaagaatttaaaataattgtcttcaagaagtccagtgagctaaaatagaacacagatagg

SEQ ID NO: 264622 - DNA, 733 bp, Homo sapiens
actttcttttagggtatcaccacttaagactcaaggaaaaataccattcccacttttcagagaaagagctcaatggtcacacagaaaagcagccgggcacggtggctcatgcctgtaatcccagcactttgagaggccaaggcaggcagatcacctgaggtcaggagttcgagaccagcctacccaacatggcgaaaccccgtctctactaaaactacaaaaaattagccaggcgtggcggcgggtgcccgtaatcccagctagtcgggaggctgaggcaggagaattgcttgaacccgggaggtggaggttgcagtgagccgagattgcatcactgcactccagcctgggcgacagagtgagactccatctcaaaaaaagaaaagaaaagcaggctcttgctttcatggtgacccctgagcagcttcgctgaatctcaggtgaggaaggacgtttactcatctctaacatccctggtgccaaacatctagttatccttgtcttataacaaaacccagaacactgaagcagaacaaaccacgcacaaaccacgctaagcctgccgaaccacacacaaccaagaaggaagggcttgccagatgagaggtcttagctttcactttgtaaaatatctactccttcaagtctaacttggacaaaaatctctaagctttcgaaaccactgagccaaaatatcaaagttttctctgaatgaaagttaaactgaaattta

SEQ ID NO: 264623 - DNA, 457 bp, Homo sapiens
aaagttgatgggtgttagttttgagaggacaacatgatgtactaaaagagagcattggagtcagaagacttcgatctttcagaccttcagtaaattctggctactctcggggcttctgtttacttataaaatgagaagtctggactaggtaattttttatgatttgaaaaacacttttttttagaacatcggatattatacacattttactagtgagttaatgtggttatacatcaaggacattatatctattaattttctctaaatatatgcaaagcaaatatgttgatcagtatgtctccgtatttacaaatattattagcattaacacattttacttcacttctaattctaactctatagctagaaaacagtttcagtcatgaagcctatccttctatataatgtaagcctataattacaacaataaaatattgtgttttaaagtgtttcagtt

SEQ ID NO: 264624 - DNA, 511 bp, Homo sapiens
cccagaggtgtgctgttcacagtcaatacccagagcaccaccaccaggaggcctggaagcaactcactgtcccacttgatgtggcctgtggaccaccagaaatttcagagcgtcacagagatgtgtggttcgatcctgagcaggtaagaaactgaggcccagaggaagtgaagggatacctccaaggcttcatacagggacagagcacagcctggtctcaggcctccctaccctggagtgagacagtgtggcttccaaccctagttctgtgactacctggttgcaggacctggagcaagacactttccccctccaagcctggtgttccggctgcaaaatgaaaacagctgtacttacttcacaggcctagcagcagagttcaatggtccatggtaagcgttctgtaaatgttagctgctgctgctgctgttgttattattatcgttattaattgagacgaagtctcactctgtctctgtcgcccaggctggaagagtgaaactccatctca

SEQ ID NO: 264625 - DNA, 446 bp, Homo sapiens
aatcctgcttttaattcttttggatatatatccagaagtaggattcctggatcttgtggtagttctattttcaattgtttgaagaacctccatactgctttccatggtagttgcaccattttatggtctcacctcagctttttaaaacctgtttaattttgaatcctaaccaacctctggtaacagataccaaattacagctagataggaggactgagctctcttattctgcagccctgtagagtgaatgtggttaactgtatttattgtatattttcaaaaagctttctgaaagagaggattttgaatgtttacagcacaaagaaatgataaatgtttgagatgctggatatactaattatcctgatttgatcattgcacattgtatgcatatattgaaatatcactcagaatcccataaacatgtacaattgtcaactaaacat

SEQ ID NO: 264626 - DNA, 380 bp, Homo sapiens
tcttcaatgtgctaagagaatgatttgacttccacacctcaagaaattatcttttgagaatgaggatgaaataagtatatttccagataaatgactcttattaacagatatttaaaagaatgtacatttggcagaataaaaatgatctcaaagaaggaatgatgagatattatattggaagtatgtaggtaaatctaaataaaaactgactgaataaagtaaaaataatatctaaatcatgaggttacaaacagctataactcaaaatactagacaaaaatagtatattagctggaaaaggagtggtgagacttaaagcattctaaggttcttaaatcatttgtaaggaagataaagatactgattaattttagacactg

SEQ ID NO: 264627 - DNA, 494 bp, Homo sapiens
accccacaaccacagtggtggaaaatggcagttctgagggtcacatacagagttcaggccagaagaacagctgcaaatgtaaacggaaaatccaagaagtggagagatatttaggaagaccaagacccaaatccttcgctgacagcagaactacacgtggtgggaggtggcgcaggagcctggtgaaaagcagggggagagcacaggacactactcttgaaacacagagctctgccagaagagatctgtgagtctgaagcttcttaaattgagcacaaccccaaatcatgaacagctattttttggtgtcttaaattttcttgcttattgtgcaagttcccccaatccccgcccccaacaccatagttgagaatgaatgaaaactttttgtttaaggaaaagtaaaacacctggtgttgcagctagtgtaactctccctacgtggtgtattttaatgatactgtgcaattaaaacttaattttatgccctgaag

SEQ ID NO: 264628 - DNA, 239 bp, Homo sapiens
ccatcagggcagagttggccttagaactccatttctccactcctaacgtttccaccagaccaagcagcttgcacaataacagctttgtggtgaatagcagaagtgtggaatccgagaggcctgagtttggttctgggttcttctacatgctagcaaaaggtctagggtaattcttcggtctctcacagtggtccagttgccacctgtataaaataaagatgaaaactcccccctggaag

SEQ ID NO: 264629 - DNA, 416 bp, Homo sapiens
acttagttttccagaattaaaccaggtttttcacacctccatcatttctgcctcatgtgtcctgtggccactttatcccctgattgttcaggatgtggctcctgctcatgattttcactctggaatgtgaattctcatatttggttattcttttttagtgtctgtgctgttctatttacttgcgtgctgttgacacaaatgtccccatgtctttctggccaatctcattgggtgacttaaagattcatcttaaatgactcctagacctacatctcttgtcatagattctttcttttgtacagtctaaatatgtatttcccaccgtctgtaatttgttccatcctgaaggggtttacagttatttcaatatagagtcaaacattaaaggtatttcttctacatgtacaaatttataa

SEQ ID NO: 264630 - DNA, 321 bp, Homo sapiens
agtttccatttatgtcctacatgatgtaggtagtattagtcctgtgattttcaagtaagttacttcctgtcttagtatctcaaattcgatacctataaatgaaggggtgggccgaaatgatcgtcagttcccatcatttccacaattctgtgttttcctaacttttcccccatacctcagagggctctctaagtagaaccattggattagcaatagaagaagaacaatgtattctataaataaagcacaagaagaaaatggcttttgtatttaaatggcaaaaagaaaaaaccagaaatacttatttcttctcctccctga

SEQ ID NO: 264631 - DNA, 602 bp, Homo sapiens
caaaattcagaaatctcattttgtggaaatttttaaatcagaagatgtcacataaaaactggaatttctggcttctctgggaaatccgaatcctaagcctctccgaggtgcctccccatgctggcagccagcgtacagagccccagctcttgctggaggcgcctcctgggccaaagccccacagtcctcactactccttgtcccctggaactgaggctgcctgtcagctgccatttataactgagaagacactaagctattttttgtattggagggtttgttgttgttgttgtttttggttaaatcttctcctcaaccatgtttttatccagcccctgaccacttcactcattagcatcacctgcgcacctcttcaagctgctgggccacgtgtagattgtgattaaactgtccaaactcctctctgcttttataatttgagtttacagtaaatgttgttagtaataattttaaatccaattcagatactaagaaatatttgaaaaccattgtctattccatgcaaaattttatgcatacacagtacaccagaactttcatatttaacggtttcatttgaaatgtctccccaggagacactg

SEQ ID NO: 264632 - DNA, 411 bp, Homo sapiens
ccaatctgagtgtgaaggtctgagaacaaggagagccaagttccagtctgaagacaggagaagaccaaggtcccagctgaaacaggcaggaggagtcgctcttgctcagcctttcattctatccaggtcttcaggtgattggatgcggcccacttacattagtgagggcaatctgttttatgtattcgataggctgaaatactaatctcatccagaaacaccctcacagacacatcaagaatgatgtttgaccaaatgtctgtgtacccgtggcccagtcaagttgacacatacaatccaccatgagcagagccatccatttcctctaaggactgctttcttgacttcccacacattctgaaacactgtgtttacactaccattcagttcaaaatattttcaaatttccct

SEQ ID NO: 264633 - DNA, 563 bp, Homo sapiens
ccttagaagcagctgttcacctctcctttagtagctcagcaagaattcagttcagtaaaaatttatttagcacctaccctgctccaggtactctctaggcactgagaggggttttcctgtactgtgcccagaactctgctcctcaggcctttctcagctcaggatactggcttaagcagctaaactgatcgcaagtgccacccttccatgctgctaaaaacccatgctgttctcctagacaaagttaatgtctggctcaacataccacaccttctctcttaagtccttaagttctgagaaagggatcccaggaggtatgcaggactcttgatgttgaatgagaggcaagaccctccactcctgttgctcgaccctctcccaggtcccctagaggaaaggctcatcctgtggcttctccctcctaaaccaatccctgtgcatccctttctttgtttgtgccacgtccacacactaatctctctgccttgtgttggcagatgctggtgggatggagctgcagtttgtgtctctgaagcagattaaacactgtctgccccagcctg

SEQ ID NO: 264634 - DNA, 420 bp, Homo sapiens
gttagacaagagtaaatgaaaagggtgtgaaatcatgtgtgtatacatccatgtgtgcatgtgtgcatatgtctatgcatgcatctgtgggcgtgtgcagattcagggagcagaggctcagaatggaagctaagaaaggaagggtgggggaaaggtagaggcattggcttccccaaacttcaaaaaccacatcctgtgtgacccagagcaccctgtggccggggctgagctgaagcctgtcaagttcaggtgcaaccgcctccagctagggagctttcttcctgctttctcagcagccgccacacaggcttctgcctctgggctgagccagttcctctggggtgagacacagaattctggggccagagttcagaaggagtcgctaccctacttctcccaggcctgtggggtgtcagccag

SEQ ID NO: 264635 - DNA, 317 bp, Homo sapiens
gcaatccactgtctttccgttcttcagtttccttatctataaaattgagatatcacttcactctgcctatactacatcattactctgagaccctgtggaaataatatgtataaaaatataaaaagaagggggccaggggctgaaaactttctattgggtactatgtccactatctgggtgatgggatcgatagaggcctgaacctccgcatcacacagtatacccttgtaacaaacttgcacatgtacccactgaatttataataaaaatggaaatttaaacaattaaaaataaatatatatgtaataatatacatt

SEQ ID NO: 264636 - DNA, 235 bp, Homo sapiens
ctgagcaatttacatttgtgaaaagggatgtttaccaacccagctgaattattatttggtggaaattgcaagcaatgggaacaggaagatagtgtcagtctaataacagagagatactctctgaaagaaaagatgtttatttgggactgagcattgtaatggaaatacttatgccaaaataaactatagtaaactatgtgcatattcagggaggtaaaggaagacaaaggttttt

SEQ ID NO: 264637 - DNA, 523 bp, Homo sapiens
cagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaa

SEQ ID NO: 264638 - DNA, 241 bp, Homo sapiens
cactccagcctgggcaacagagcgagactctgtctcaaaaaaaaaaaaaaaaaaaaaaaagataaatgaacacacacacattaattcctaataagagaaatgtaaacatttacttgttattatttttttcttccagaattggttttatttattttcaatttaataatagagagtattccttctttatatttaaaataaaatatttcaactcaagtggtattcggatcatctataggattaa

SEQ ID NO: 264639 - DNA, 106 bp, Homo sapiens
taatacttagggtatataggattgagtcttcagtgtatggcatatcatcacactatcatctgtgaaggcccctctattgtgtgtgtgtgtgtgtgtgtgtgtgtgt

SEQ ID NO: 264640 - DNA, 2540 bp, Homo sapiens
ctgtgcttcagtgggcttttcactacctttagttagttgcactaggctggttgctgtttaccttgcatggttgactgctctcttctcacattgtgtgccaggaagggcactgcaccttggtataaatgctgctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtgggttttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaactgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaaccaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagtttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaattttttt

SEQ ID NO: 264641 - DNA, 2618 bp, Homo sapiens
ctgtgcttcagtgggcttttcactacctttagttagttgcactaggctggttgctgtttaccttgcatggttgactgctctcttctcacattgtgtgccaggaagggcactgcaccttggtataaatgctgctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtggggcccttccagagaaatgtactgaaaaagtctacgcaatgtctgggatttgctaaacaatacctggaaagcagacaggtttttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaactgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaaccaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagtttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaattttttt

SEQ ID NO: 264642 - DNA, 160 bp, Homo sapiens
ttttacagatgaagaaaccaaagttcaaagaagtgactgattcagagtcatgaaatcggggagctgggccctgaatccagactggtctgacttcaaagccttgctctctttccactgcaatattcaaaatcaaaacaaaggtttttgttagtgattctca

SEQ ID NO: 264643 - DNA, 701 bp, Homo sapiens
agcccaatgggctgggggaaggtctgaacactacagccttcaaggcaaagggaggagatattttgtccagagaataggagccgggggcagcccctggggcagatgtgctgaggcaggggcaggtggtgtcctgaggcaggggcaggtgtcctgaggcaggggcaggcaggtgcatgggccctgatgggtgaggggttgggggaagtgtgtttcttggggttctgccttggctgccactgggattgggaggggctgaggccccaagccttcagggtctagacagaggccatgatgcctgctgtacccagagagaaggccaaggcctcacggcctccgaggccctacatagtgtggcccataccccagacctcatctttgctgtttcttcctctcccacccccgacagctatgctggcctccttgctgctcctcaagcagaaacacccagcacctcctgcctcagggcctttgcacgtgctgtgcccgctgccatctccccagcatccatggggagcctcccctccatcttcacgtctctgctctaaagcccccttctcagagaaaccttccctgacccccacatatacaacagcaccctgatcctggccccctctctccccttcaccctgggtgtgtctccagggcacatatttcaacccaatatgctgtgtaattattatctttattattatttttgagat

SEQ ID NO: 264644 - DNA, 362 bp, Homo sapiens
tctccacacacctgcagggcaggcatcagcctcacccactttcagatgcagaacctggttcagagagctatgctggcctccttgctgctcctcaagcagaaacacccagcacctcctgcctcagggcctttgcacgtgctgtgcccgctgccatctccccagcatccatggggagcctcccctccatcttcacgtctctgctctaaagcccccttctcagagaaaccttccctgacccccacatatacaacagcaccctgatcctggccccctctctccccttcaccctgggtgtgtctccagggcacatatttcaacccaatatgctgtgtaattattatctttattattatttttgagat

SEQ ID NO: 264645 - DNA, 959 bp, Homo sapiens
  misc_feature (854)..(854): n is a, c, g, or t
agctgcagtggcggggagtggggtgcggatcttgtgtttgcgcacgcagtcgccggccacctcaggccggagctagagatacggctcgggataggagggcccggcggctctgaggcaggttcgcctcgagccgcacggcccggagcagcggctccgcggtggtccccggggcttgagaggggtgcgggcctgggagcccctgagggcctgatttacggaactccccctccttcctcctttctgccgttccctgctctgtggcggatgcgcagggatcagtagggacggcagcagtagggccactcgggcctgccccgcttcccgcattgcccggtttggcgcgccgcctccgggccttggcaaagccccagcgcccgattgtcactgaccagtgcttggaagtcctttaccgactgcccgtcagcgtcccgcggagaggattttgcgtctccaaagacgcccctcttccgaaaacaggctcctctgtgttctcagtcgggtatatttttctgtctccaaactagattggcagccgttttttgagagcagggtcttgctctgttgcccagactggagtgcagtggcgccatctcagctgactgcagattcaaccttctgagctcacgaaatcctcccatctcaacctcctgagtagctgggaccacaggctgagcacagggttgctccaggtgggcccaaatgctgaagagcctcatgttagagtttttcacctctgcgatggaactgtggtggactccagtatcatcattccagggaggcatagccgcaccaactgtgttcccaggtttcacatggagaagggttttagaaagtgcagatagccttgaaaccantggtttcctaccactgtttatttcagcataactttttttgtgtggaatgctagctctggaagagcagaaataaatacagcttaagctttgaaccatatcctgctg

SEQ ID NO: 264646 - DNA, 309 bp, Homo sapiens
ggaaatggtctcaaatctccaagaacagaaacttctcttgacagtgcattctgttaccttcagtatgaaaactggcaatgacacagcaagacctgcaactcaggcttcctgtccccagccctccacaatgctaagagcaatggcagagcacctgtccaaggcctcgaatgagctgttggctatacagaagcatctggaaggatgcaagagcaccctagaatgactatcataaaaaacctgccccattcccccacaaccctttcccagcccttctgtaatgtgtggttaaactgagtctcatccattttt

SEQ ID NO: 264647 - DNA, 490 bp, Homo sapiens
atagagaccggcgctcccacagcccgcctgccctctccgcgccgcgtcgctcgggccgctggccttcgcttggcgggctcagggagcgagggaggcggcggctagactggcgggcgagcgggctgcgggagcggagtccgcgcgtcacgctcggagaagcacctccgcgagctgccgcctggtcccccagttcactgtattttttaaattttctttgagacttccttttgacccatggattacttaaaagtgtgttgttttgtttctagtcatttgaatatcttcctgttatctttgttattgatttctcatttgattccattgtcattacaaaacacactctatatgatttcacttatttaaaatttgttgaggcttgtttgatagcccaggatatgacctatcttgggatatatattttgtggtcatttgaaaagaatgtgtattctgatgttgctaagtggagtggaccataaatgttgatttgatt

SEQ ID NO: 264648 - DNA, 1223 bp, Homo sapiens
atctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaa

SEQ ID NO: 264649 - DNA, 450 bp, Homo sapiens
ccccccccccccccttttgcctttctaataacacccctccacacacacatacgcttcttgccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaa

SEQ ID NO: 264650 - DNA, 1362 bp, Homo sapiens
gattcttgctccaccctgtgtacctgctccgagtgtctttccccctccccaccccagcaggccagtcctgggccccagctccagagcactcacgggctgccagggtgagcaggctagaaactcacgacaccaggtagctctgcaggtgctgggagggcaactcagcccagaggaagagcaggctggggagccctcaccgcccaatggggactgacccctggcccctgcccctctccaccccactgccctgaagccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaa

SEQ ID NO: 264651 - DNA, 1017 bp, Homo sapiens
gattcttgctccaccctgtgtacctgctccgagtgtctttccccctccccaccccagcaggccagtcctgggccccagctccagagcactcacgggctgccagggtgagcaggctagaaactcacgacaccaggtagctctgcagaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaa

SEQ ID NO: 264652 - DNA, 1034 bp, Homo sapiens
caccactcctatagatcagtagaattagaattgtgaagatagactgcatcaaaaatgatggtgcggaaagtatttaaggacgtggaaaatcgctcaccctctagtgctaagtgaggggaaaaaaaacactgtatggaaatacatacactgatcacactaaggggaggaggggtgagactgtatttcttagttacttctttgtgatcttccatattttccaaatgaatgtgtattgtatttgtaaatagagcagtactgttttaacacatctccagccccatctgaagcccttttagagaggaagtcttgaagccctttaccctgtccttcctgagtgcagccacgttctctggacacccccagggcagatgctgaatggggagaagagtgggaaccttgccccatgggaatcccaccacctgatgcccctgcgacccacccccgcatcctgaccatcctctctggtcctctgcagaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaa

SEQ ID NO: 264653 - DNA, 414 bp, Homo sapiens
tgccctgctgtggctggagctgtgaagggaagcccaaaaattcattctgggctggtcctgtgtgctctggtgggggctgttggaggcactgtggagcccagaagggcacatctcccagactttgcaatcagcgaaggctcccccagaaagaggctctgagcttcatcccaagctgcgccctggccctagccctggccctcccctccttctcccccaagtacctcctgagcttctgcccaccaaggctggtctctttcctccccagaggttaaaaagtacaagtgtggcctcatcaagccctgcccagccaactactttgcgtttaaaatctgcagtggggccgccaacgtcgtgggccctactatgtgctttgaagaccgcatgtaagtacctaagacacaactatgtttattt

SEQ ID NO: 264654 - DNA, 420 bp, Homo sapiens
ccccagttaggccctggaggtccctaaaaggtctgatgggctgggcctgctttcttccagctctgccagagtggaaacttggccccagctatggcctggtccaggtgtgggctgcagtgggaacttgtcccatgctactgggacaccctgcttccacaaccatcagcttctgccagcgtcatttcactgatctctagttcattgatctctaccctccaccacttacactgacctcgtggcatcttggcctaatactacagggtgcatctcttctgatgaggacacttttttctccacactctccggtcctcagctttgttaaggtacacgtgacaaaaattggatatgtgaatgatgaacagtgtgaaattttgatatatgtatacactgggaaatgattaaatcaagctaatgaacaca

SEQ ID NO: 264655 - DNA, 787 bp, Homo sapiens
tgctccttaacattgtgttatacattgtctgtctccccaactggaatgtaagtggcaccagggcagggacttgggttgttttgttccttgctgtaagcccagggcccagggccagacctggaacaattaggtgctaagttatttgctgaatattctatgaaggaatgacaaaggaatgcataaagaacttcaaagttcaactcctcgaacttcaaacttcaaatccccaactcctcctgcctatgctggacgattagggcagtaacaggagtcaacttgtgctgtgctgtcaccttgcctggatccgcatcagccctgcagctcccactttggaggagacttgcccagggacctacagctctgaagcttctctgacagcctctgcagctcttggaacttatctgggctgctgctgtgcagaccatggatgcgtagctgagttcctgcccctgatttcctagagtctcagaaagacagggaagtgacttacccaaagtcccctttcaccctataaacagttcagcccagggagtgaggctgacacgcaaatgcagctatgtatagactcagagtcatccaaggtcagggctgggtggagccttggtcacatgcaggccaacctgtgtctggagataatgcaagccagtgcaggggttagcgtgtacatggactctggagtctggcagatctaagccccacccaccaacctgtgaccttggagaattatttgaaaagacattatttgaaaagcagatgtaaaatggaaataaaagttcctatttaaaac

SEQ ID NO: 264656 - DNA, 1003 bp, Homo sapiens
aacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggtgtcagcaagaagctgacacacctgtgcttgcactctctgagtggtaccgccga

SEQ ID NO: 264657 - DNA, 942 bp, Homo sapiens
aacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggaaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggtgtcagcaagaagctgacacacctgtgcttgcactctctgagtggtaccgccga

SEQ ID NO: 264658 - DNA, 947 bp, Homo sapiens
aacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaactgtctcttacagaagccaattgcagactttctggtaccgaccgat

SEQ ID NO: 264659 - DNA, 525 bp, Homo sapiens
ctctatgcccctgagcagctcctattggctgtccctggtcagggttgcatgctggtccaatcatccctggcgcaaaggagaggccgtggacatgaaaggaaggagccactgggtacatgtggtgtcacagatggcctgctctgcacttctacttctaaagcacagatgggaagaaatggatcttgtctacgatctaccctgtacccaactgggcacttacacagaagcctcactcattcaggactgcattagaattctcatggctaggttggccgtcacttcattttaaaaaaaaattatattttacgactgcattggcataaagaataacatctaggctggattcattgttacatattgatttttttatatttatttttttttcctgtttgtaaaggaaaataacaacactatcatgtatccctaacagtatctgggcctctggcactgtgtctactaggcctaatggaaaagtagatcctgcattcacccattcaataaatatgtattgaacatctactatgg

SEQ ID NO: 264660 - DNA, 197 bp, Homo sapiens
tctcaaaaaaaaaaaaaaaaaaggaaagagccttgtcccagtagcagactttcctgtcacttaaagctaggttagaatgagcacacactcagctggatgtttttcactacagatgaaaagtttgctacgtttgtttacacaaataatcaggaattatgaaatgctgtgtcctggcaagaaattttatttcacttaca

SEQ ID NO: 264661 - DNA, 409 bp, Homo sapiens
ctacaaatggataacatacactattttcttctgtctcaaacttcataaatttgattgcattcgttagaaaactttaatacattttttaaaaataatgatttcctaagtcattggctgtaactggactagattcaaaagacacaaaaagatggcaaaattgctcacaatttgaagataataattttctaaatatactaaaacaagtaaattacttagaaagtaaaacatttatgccatagttacatttagaagaggaaagtgcttgccttaaaacttcacaaagaatgaagacgtatgtactactaagtattcatcttcagaacttttaaaacaccaataaaatagaacaaaggaataaaagagatagaaaccaactgaataaaacacaaataaaaataaaaggataaaa

SEQ ID NO: 264662 - DNA, 730 bp, Homo sapiens
  misc_feature (39)..(39): n is a, c, g, or t
  misc_feature (54)..(55): n is a, c, g, or t
  misc_feature (82)..(82): n is a, c, g, or t
cacgtctttggctcaatgtacgctcagaagatagcttanctattccagagctgnngacaaacagttcactaaagcatttagnattcatctgaatgttacagtcctttcacatatgagaatatcaaatcttatttcttcagtaagcaaacacagttttgacacccacaacttaatcttaagtggtaattttgcttaggaaagtggctcatgcctgtaatcccagcacttcgggaggctgaggcaggagaatcacttgaaccagggaggcggagatggcagtgagcctagatcgtgccactgcactctagcctggtgacagagcgagactctgtctcaaaacaacaacaaaacatttactgcattctagattttgtcttggataacctttttctcctttaatctctcagttttgtgggtgagtaaactttaaatgaaactctaaagttttcattgtatttgtattgtaaaataagtccacctctttgtagttacttagtgttttacgtttaaactacaaagtatcttaatctctgacgtttctcattaagctgttctctaggtaacatttcttttgcccttttattattaattatatagtttccatccttcactaggcccttagtttgttaatgttacatgaagcaaaatggtcaacttcaaaatatcttatttgttgccttcaggttgcagcaggagacttaaagcacgtaatttctacccattaattgta

SEQ ID NO: 264663 - DNA, 216 bp, Homo sapiens
atgaacctctgcaaccccctctgagggaaaccctcccgcattctgggatgccggggctcagagggtggagggtagaagagcgccagccgtgagaggcaggatggggcggcccccgagggcagggctgtgcctggaggcagggctcctcggggggtcagctcctgggcggtgggagtgaccgagtgggctcctgagggaagcggctttcaggaagga

SEQ ID NO: 264664 - DNA, 259 bp, Homo sapiens
ggaggaaagccaacgttactgcagaaactaggaaggttgccacacaaatgccagaaattttactacatttctggtagacattgtgcagatagcgccaaacaggaggcagccaccaagtgctttatggcctctacataccaatagcccctaattaggaggtgaaagtgtgagccttgaagccttgagaaagatgggtccacccaatttaggactcctttggggtgctgccatcaacttccggaggcagctgtcctcagat

SEQ ID NO: 264665 - DNA, 498 bp, Homo sapiens
ctgcctaggcctgttcgatgaagcaccaacaagccccacagctttgttgcttttgctatgcccactgggaccagtgagagaagtgcggtcttatccctgggaggagagaaagagccagcatctgcaggcgcccacaggatgtcaagagtttcgcttttgttgcccaggctggagtgcaatggtatgatcttggctcactgcaacctccgcctcctggattcaagcaattctcctgcctcagcttcccaaatagattccagacattgtatggaaaagcatcgtgaaaatccctggcctgttctgctctgttctgattaccggtgcgtgcagcccgcagtcacgtacccgctggttgctcaatcgatcacgaccctctcacacggacccccttagagctgtaagcccttaaaagggacaggaattgctcgctcggggagctcggtttttggagacgtgagtccgccggtgctcccagctgaataaagccctttccttcca

SEQ ID NO: 264666 - DNA, 301 bp, Homo sapiens
ggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcg

SEQ ID NO: 264667 - DNA, 479 bp, Homo sapiens
ctggtttctagtgttttcctagctggacaaatttggcatttgacagatcattcctatactattggcccagtatattttgtgggaaataaactatttgggggttcaatcgatgtaaaaaaaaataggcatttctgatttcatttcagatgttgcagtggtaaagtatattccagtcaggagctggtgaggcctgaggcccaagtgtgcacccacgcggggttgcagagaggccgagaagtgcgttattacctcccttctccttggtcctcgtgggtgggcatgagaggttggatctgtcactctgagacagcagagggggacaaggagaagtgaatgaaatacgtgttgcttctccaggccttcatatcagaaacacctgccgctgccctgaggccacaaggctggccgccggctggtgctcttggctccctctgctgcttgctgggtgaggatgccctgggcttgtggcatttttctta

SEQ ID NO: 264668 - DNA, 427 bp, Homo sapiens
gcaggctcctacaatattatgttcttaatttgcattagtctaatgaaggaatactgggggaagggtattcccctggcctcatgttttaattaggtgtgtactttaccgtctccttttctccgtttaagagtatgaaaacttgtttagaacatgaacttgaagaacttgaagtgaatgtttcacccagctcttcattaagtacttgaactacttaagtttgtggttttagttgtttgacttcttgacattctgaaggaaatggttacatagtctcataaactcagtgattctcaaccctgggcacacattagaatcacttggggatttaaaaaattttaatgctcagggctttctttcaagctaattagtctgtcctgctttaaacccaatctgtagtgtttacctgattccagttcctgggatctgg

SEQ ID NO: 264669 - DNA, 455 bp, Homo sapiens
ttatagattaattgtgatactgataagttaggtaatctgccaaagttctcagagcttgtacatggcagagcagaagacaatcctcagccttctgaggccaccaagcccagtgccagatccattacaccagagctgccttgtgtggatatcacatggacagacgaagcagagaaaagaaggaggaagggggacagaaagaggaaaagagagttgaagtccatgactacagctatccttaaggtccctgaagctgcacagaaacaaaatttgtctccccacacagcatgaccatgggaaaagacatctttagactgaaaaataaaaactacagccaaagttcttctactagattgtttttattctgaatctttatctttaaaagagactaaataattgtgaaaataatttctccacatattcatattttatatcacatctggaaatttcatgttctg

SEQ ID NO: 264670 - DNA, 397 bp, Homo sapiens
ctcttatcgccaacactagatatgaatccattaacacgacatacaatgaccagctgttatagagccattcttgtatccctgaaaggctgaaatgggggaaaagagagaaacagactggctagaatacacagctcctctagtggcattcctgttaaaacaacctcataggtcagagatgccactgatcactcctagatttcagtaaatatataataacattaatcattaatgtctgaacttgggtgttggggataaatagtatgttatccccaacaccagctacctgggatgctgaagtgggaggatcacttgagcccatgaggttgagcctgcagcaaactgtgattgtgccactactctctagcccagaagacagaacaagagcctgtctcagaaa

SEQ ID NO: 264671 - DNA, 372 bp, Homo sapiens
caaatagttgaaggacagagttcagaagtagcaatctgaaaacatattttagctctaaagttttaaaagaaaatgccaccttaaaaatgcttaccactaatggatttttaatcacaaaatgaagcaaatggttaaataatacacttcccaaaattatatcataaatacactaagtgtaatgtggactttttctccctgagtgtaagaaatgtaaaattacaaaatgtttaagcattaaagtgcaaatatcaatctttaggcaatgaaaaacagcgagacaaatgtataaattacatataaaggtcataactatttcagaatttgcagaataataaatgtagaaagttttaaaataataaatgagcaactccc

SEQ ID NO: 264672 - DNA, 667 bp, Homo sapiens
gggccattgatgtaaagcgataatggagacatcagcgcccgtatcaatcattccctcaaacttccttccttgaatatgcacagagcacacaggacgagtgtcagaaatcttgctggctcaataagctgctttgtcctgatagtctgtgctaccaaaacctccagttctggtacaagaactggatcctaaaggaacgtaagggagtataagaagctgagcaatgcggtctccagctgccgtatatcaagggactgcagagctaatgacaatatgaatttcacctgaatagtcagaatcaattacaccagtatgtacttgaacaccttttaaatttaggcttgagagatcaaatagcaaaccgacactgccagtcggcaaggggccaaaaacacctgtgggaacagcaataggtggctctccaggtaacagagaaatatctctggtacaacagagatctactgatgctgagcctgtggtggcaggggacaagcattgtactgagattcgtgttggggcagagccattagatcctgtggcacaaattgctgaagtgggaattgggatgtaggttgaatggattgggctggcaaggcgctcatcttgctggacgccaggggctcggagttgaggaatgccccattgtttggaggggcctagggctggcccc

SEQ ID NO: 264673 - DNA, 638 bp, Homo sapiens
atccacccgcctcggcctcccgaaatgctgggattacaggtgttagccactgtgtcggccaggaaggagattcttgataagtcattgaaatttattttattttgtactaaagaaatatttagtactggccaggtccggtggctcagcactttgggaggttgacgtgtgcagataacctgaggtcaggagttcaagaccagcctggccaacatggtgaaaccctgtctctactaaaaatacaaatgttagccaggtgtggtggcaggcacctgtaatcccacctacttgggaggctggggcaggagaattgcttgaacctgggagggggagcctgcagtaagccgagattgcgctgctgcactcctgcctgggcggcagagtgagatttcgtctcaaaaaaaaaaaagaaagaaaagaaacatttagtactgtgaaagtgttggagtctgcattaaatgataagctaatgtattttattggagttaggaacagaacaacagcctatatttactactatacttatgctagttcactgttttaaagcgatacaaattgaggtagcatctgcaaaatatattctcttgctctgtcgcccaggctggagggcagtggtgtgatctccacttactgcaaccttc

SEQ ID NO: 264674 - DNA, 273 bp, Homo sapiens
aggcttctagagaaaaacagaagaatatcttcatgactgtggggttggcaaagatttttttccatgagaccgaaaagtaccaacctcaaaaaaactaacacattgggtttaatcaaaatgtaaaaccataagagacaccgttaagcaaatgaataaacaagccaggaccaaaagaaaatatttgtaatacatacatctgacaaaggatgtgtatctaggggatggaaagaattcttacaactcagtaataaagataactcagttttaaaattt

SEQ ID NO: 264675 - DNA, 302 bp, Homo sapiens
taaaaaacaaatagaaaatatattatattctacccacaccgcaatggatcaaactactgttaactctgttaacacagcgtgtagatcactgacatcgatactaaaggtttgggctcctttctgaaaagaaggggctagccaccaggactctacgattataacttgcaactcccaaaggtgatgcaggataaaagttataacaaagagtaacttccccccgcctgggggcgagcgggggagtctagaacagattgcccttcgtataacagtaaagattaggagttatttaccgtacaccttaa

SEQ ID NO: 264676 - DNA, 315 bp, Homo sapiens
tcagccctaatgagactacattcaaatgaaggaagacagatactaaaaatgacaaatatataacagtatgttagaggatggaaagtgctattgagaaactacagtatggctaggaggattataactaggagaatcagagagaaggcgacattagaacaaggacttgatgggtacaagaagtgagccatgtgggtatctgagaaacgaatgtttcaaacagagaataatcagtgcaaagacccagagttgggagtgtgcttgatatagtcaagggatactgaggaatccattgtgactggagcagagtgaacaaag

SEQ ID NO: 264677 - DNA, 276 bp, Homo sapiens
tgtaaaaaaaaaaaaaaaaaaaaaaaaaagcatacaacagaaactgtatgtggcctgtgaaacctaaaatatatattctttggctcttaacgaagatgtttgccaacccctggtatatattaaagacagttattttagagactgtgtctggtaaccctattatttgaaacttctttgttagtttctggagtttattccatactttttatcagtgccatcctgtctcgtcatatgtgcctggttttattgggctgagcaatggatgttgtatatgtg

SEQ ID NO: 264678 - DNA, 445 bp, Homo sapiens
cattcctggaattcttgatttaattggtataaggtaaagtctggacatcaaatccagtggtgtcttccaaccagccttgtggccaggtctgacatttacagccatattggccacatgctgcacaattccagaaggcttcattcacataatctatattggaaatagtttgttctaaatttgtgctgtacacaaccttcaaaactgtatacggttggctgatctatccagccttattctgtttgcaaaattcctttttagctttctcaacaccactctctccctcttcccttgctaccactttgactactctttctcatgttctttcaacttgcactctctccttgaggaaattaatcagctcccaatctccagccacctctttccgcactcatgagtcacagctccaaagctcgtaagccttgccacccacgcaaccttcaggcat

SEQ ID NO: 264679 - DNA, 243 bp, Homo sapiens
ggataagggacacagaacccacttctcagcaggaagcgcacgtacatcacacgggaagagtgcgtgggagggacgccacccctgaggccgtcctcggaaatgacatctaccagcaaagccgcctttcattccctgactaggacagaccccgttacaggtggagagagagacaggaagggagaaagaaagacagaggggcctagcaagagaattaaaaacaaagccgccgtctgcgaatctgct

SEQ ID NO: 264680 - DNA, 422 bp, Homo sapiens
tgttttaaacaataaacaaagccaggaaccagtaaacctgacaggcagatttgtcctttctcgttttgagtgatagggaaggccgtgaattatagtcctcaatgacatacacagaggggcattgaaaaggcttatctggctgggcgtggtggctcacacctgtaatcccagcactttgggaggccggggtgggtggatcacctgaggtcaggagttcgtgactagcctggccaacatggtgaaaccctctctctactaaaaatacaaaattagctgggtgtggtgggacatgcctgtgatcccagctacttaggaggctgaggcaggagagtcgcttgaacctgggaggtggagattgcagtgagccgagattgtgccattgcactccagcctgggcaacaagaatgaaattccatctcaaa

SEQ ID NO: 264681 - DNA, 984 bp, Homo sapiens
gcagagaggctggtgggtagggtgaagaattattagattgattaatatgtttactttgagatccctatggttgttcaagtgtagatgttaagtatatagttggaagtactcctttggaatttgggaaagaagaaagggtgagaaatatttggagtccataatatttatgtgataaaaaattaataagattttccattgagtgggtatatagaaagaaacaaaagtcaaaattagaactctgggggaacattagcatttaaggggacaggatagacaaccaagagccaaagggacacattatatgatggagaaatgacattaattttggcagtagatatcatttgcaaatatatattagttaggtgttggtggaagaaagctaggttgcaggaaatgaggaagtaaaagatcagagaagagagacagcaaattcaaatacctttcaagaagtttggtggtgaaggaaagcagagaatccaagtgatagcttaaggatcaaggctggtttgaaaaaaaagataattggtgctttatttttcctctaggttaggacaggcttgagcacacttgtagctagagaggagagttgccagaaggacctgaagactgaaagaatggagattatttccggtcccataaaagtcaagagtgtatatgggatctacagcacagctagaaaggtttgacccaacagggagtagagacatttctttctctgtgacagaagggtaaggaaggagtaaagagaaagacgttgaagaatattatcaaatactgcagagattaatcgtacatttgcagtagacctgggatcccatgtagttctttagttacataatcaaggtagattttaagtatttgagtcaaatgaaccaggtttgtatgtaatcttaaaagttttttgcaaaatcatcaggacagtttcaataaaatattaatgaaaatgttataaaagcgttgactctgatttgggtaagaaaagta

SEQ ID NO: 264682 - DNA, 557 bp, Homo sapiens
ggctgatctacccagtcagcaaggccagattgcagagaaactcagagtctaggaaaatgaatgtctaggaacattcctcaaatagtcctaccagaagacacaaagatgatgcatccggatgaagaatatatcactgagattaatggccctgggttgcagccaaaagcatctcagagggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgtaaatgtgtct

SEQ ID NO: 264683 - DNA, 753 bp, Homo sapiens
ggctgatctacccagtcagcaaggccagattgcagagaaactcagagtctaggaaaatgaatgtctaggaacattcctcaaatagtcctaccagaagacacaaagatgatgcatccggatgaagaatatatcactgagattaatggccctgggttgcagccaaaagcatctcagaggtagaacactgttgcagatggtgatgttaccatttgaaagtaagaagaaaactagtatctctttacaccaagagtaaaaatagagaagatgcttacaaactgcaacacatagagtttcttgaaatcacagtttgggagtggaggaaaaggctgcttaagtgtttggaaagggagagtaaggatgaaatagagtgggggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgtaaatgtgtct

SEQ ID NO: 264684 - DNA, 596 bp, Homo sapiens
ggctgatctacccagtcagcaaggccagattgcagagaaactcagagtctaggaaaatgaatgtctaggaacattcctcaaatagtcctaccagaagacacaaagatgatgcatccggatgaagaatatatcactgagattaatggccctgggttgcagccaaaagcatctcagaggtagaacactgttgcagatggtgatgttaccatttgaaaggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgtaaatgtgtct

SEQ ID NO: 264685 - DNA, 350 bp, Homo sapiens
tgagatgcacgttcataggctgatagttcctaaagggctaactggaattgtttaaaccattatgtcctattgtagtttatttacacatacttttctcagtttgaatatacctttggaaactagagatgatcattattagtatctgaacaatgattaaaattgctttctttctccagtgatagattggtagctcatatagtttgggattatttacttatatgaagactttaggctgggtacagtggctcacacttgtaatcccagcattttgggaagccaaaatgggaggatcacttgagcccaggagtttgagaccagcctgggcaatgtagcgagatcctgtttctaaa

SEQ ID NO: 264686 - DNA, 377 bp, Homo sapiens
acccgaagctactgaatcggcgctctgggcaccttagatgaacccgtgcgcccgccgtctgaaccgtcgaggcgcagcgctagatgcctcagaccgcccgtgggtcacaagtgcaaaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaagga

SEQ ID NO: 264687 - DNA, 187 bp, Homo sapiens
tgtgtgaggtgaaaatacgaggtgatcctgtgcatgtggtgaccctgtgtgaagtgactctgcacaaggtgactgcatgagatgaccctgcataaggccaccctatacgagctctctgcgctgagctgcacaaccccagtccatgcagtgactcctcccagcaggctcgtatctttgatgatgctgt

SEQ ID NO: 264688 - DNA, 502 bp, Homo sapiens
ttttagaagacagaagaactgttgggatttggttttcagaaaggcgcaggccacaacttcaaaatgatgtaaatgccacagatggctgcctctgtccatgaagacagacggtttgatgtctcatccttgttccagctgtttgatggagcccaggaaagaactctctccccagtgcaactccatccaccacgttgaggccagaggcctctgaaatgtgccacagaagccagattccaaatgggctgcaatttgctaagcattacagctatttcattctgctgtacaagcttcagtacaagaagaaaaactatcaatcactaccataacaaacacatatttctaaaatagaccctcctgtctggaagctgtaggacagacacttgcactcaaagtaaatggagtttagggtcatcattgtggtttagtgctcctgtacctttatgatgcatgataaatgatcaactggaatctgctaaataaatatttttctatgtagatctca

SEQ ID NO: 264689 - DNA, 655 bp, Homo sapiens
atcctgttacccatgcggaattggggtggtgtctgacactgacattcagccaggcactttgggaggccgaggtgggcagatcacctgagtcaggagttagagaccagcctggccaacatggtgaaaccccatctctactaaagatacaaaaattagctgggcgtggtggcaggtgcctataatcccagctactcgggaggctgaggcaggagaatcacttgaacctgggaggtggaggttgcagtgagctgagattgagctactgcactccagcctgggtgacagagcaaaactctgttcccccactctcccccaaaaagagagggtgagactaacaccaggaggtgggcgagcggcattgaacagatctggggagctggccccagaaagcacctccacctccacctccttgagatgttgacggtggtccctgtgaagtttggcttggaaaggtggtgcctggctgctggaggacagacacaggctgggtacctgcggctccatctgaggggtggggtggaggcaccccgaggaatgtgctcactggaagcccagacagccctgcccagcgctactgcagtccctggggcctcctaaagccagacggggcgggggtgagagagggaccctttgcgctcccaagccagctgggtgg

SEQ ID NO: 264690 - DNA, 439 bp, Homo sapiens
aaggtagagaccctggacattgtcctcagggcagtggggaagcacgggaggagtgtaagcacggtgcggactgtgtcaaccatggaggacaggcaagagggggtgagactaacgggccgggtgcagtggctcacacctgtcatcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatcta

SEQ ID NO: 264691 - DNA, 744 bp, Homo sapiens
ctgaatcagcactgtaccttccatggtacagtgtgtgtgaaatttatctttttcctaaagctaatttctcaatctattctagggaactgattaatttccattttagattcatcttgacaaccgtttacactatttcccctatatcttcaagactactgggcttggtaaggagccagccaactattaaaaagattacattctcattttctaactatattcaggcttcttgaatgactctgaccctgtccgtaatatggcatgttctttcctaactgggcacaagagtttagattatcttcagctagttttcagtatataaaggaatacacctccatggttcaatcaggaaagaggacttctacaggattctactaaggatcaatctggttctcaaatgttacaggtcttctttttggcacagaaaagatatttaacagtggtgcacaggcctgtcttaaaaatcctactagagatattctcacctccattacccctttgttttcaagataaagagagtttccgggaagatattcacaacagaagaggatatttttgaagtgttactttaaaggaaggtaaaatgggtttaggcaacttattttgaagctaagccaatgtaagaattctaaaataaattgagggcatgtcacatctttaacagatgctcacctggggagaaaatgtctgcaatatctaaaatgtaggggattattagatttttcaaactcttataaatcagcaaga

SEQ ID NO: 264692 - DNA, 132 bp, Homo sapiens
tccagctgcataatagaagattatggtgggccggccatcttcttgcactatgcaaatgacacacctggtctgaccaatctctcataccctatgtaaatcagacaccgcctcctcaagctcctgtataaaatc

SEQ ID NO: 264693 - DNA, 213 bp, Homo sapiens
cctgttcctaaattcctttggtcccattaggtactttgcaacatttccatttcttctgcttctgttagaagggacctttttaaacttgaagggcagaggcccccacgcagctcatgcagatggtggtactaactggagaagcagttacagttttacctagcatgcatttctgttggagctcatttcaagtaaatgacttatactttatgtcca

SEQ ID NO: 264694 - DNA, 494 bp, Homo sapiens
agtttgaagagaaaggatcgtaagaaaattaaaagggaggaattgtaagatgcaataaatctgagtttctcttcaaagggtttagcctattaacttccttatccttgttctcaaactcaactttcttgttcttccttgcccctagttaccgtaaacagcctatcccccttcccatcagctctaatcaataattcacatctgttcccttggttacctgtatcctttgtttccctgaaactgcacatctcacatgctccacctctgtacctcatgtccccctccccttttatatttgggaaaatatgtacaagtagccaatcgggtcagctcagattgtgcggtccagccacagcccatgggggagtgacacagagatagggactgcgttaaagataaacccccccgccccggtctcctttgttctgtgtgctcttgtgatcttgattgacacaagtggcacccttttgcagaagtaaattgccttgctgaaataa

SEQ ID NO: 264695 - DNA, 321 bp, Homo sapiens
ccagtgagcttgctggttggctgtccatgagtgttggctgccagatgtgccatcatccggcacaggatgtacaggaaagagggcaatggcttcccggaccagagtctccacccagaattccagccaaggccccagagctcccaggacctggagaatttgttccccctggttgtgtttggaattggctggttttctgggcaccaggcccagctcagtttaatttttgtttatttttatgtacagattctcttctgtttggggatgagctttgtgtaaattattattatttatatgataaagaataaatcacaccaaataaaa

SEQ ID NO: 264696 - DNA, 445 bp, Homo sapiens
agcaccaaatctcagtacctacaaggacaaatattgatttcttcctcttaaatctgcaagtcagctgtaactccgccggtccctgctaggattggtagggcttgactccaagctgcagatcagattcattcaggggccagtggctccccaggccatattcttcttatggcagatgtgcaagaggccatgttgaaccagtaacattcctttggccaaagcaagtcacacagctaagctcaaagttgaacgcatgggaaagtttgctctacctgtttttctgaaaatgtttgcaatgtcacatggcaaagtgtttttatataagcctattaaaagagtggagtaaagagttgggaagaaggatctaatattccacagttaatatataatttacagtactctgaaactgacttgttttagatcaagataacaagcagagaaatagaca

SEQ ID NO: 264697 - DNA, 271 bp, Homo sapiens
cctgctaccccaggtctatggaaccttggccttttctgaattcctccttttttttttccggtagagatggggttttgccttgttgtcctcgctggtcttgaactcctcgcctcaaatgatctctcctgctgcccaggctggagtgcagtggtgtgatcatagctcactgcagcctccaactcctcggctaaagtgatcctcccgccttagcctcctgagtagctgggaccacaggcgcacgtcatcatgcctggcctgttccttttttctt

SEQ ID NO: 264698 - DNA, 725 bp, Homo sapiens
ggctgccgtaatggctgcggcctgcctgtcagagccaggctagacagggcttgtgggtcgaggaagcatgggacaggggctggggttgtccagggacctggccccagtcccaaagctgaggtttcccacaactgtgagttggccagatagtaaccaaagatactgatgagataggtcagcagaggaatgtatccagccggcctaggtacctctacctgtccgtgttgttgccccaccttgcagaagatgggcctcctcgacagttctcagcgtcctagaaggcaggggacgtcacttcattggacctgaggcatgaaggcagatggaaagctcgaggggcgggcatcctgtggttacacaattgaacactggcttcctttcccaaacatgctctgcaaatgacctctgcccttcctcgacccagtgtctcctgtctcctgacctgacagggcaggatcttcaggccaatgctgcggttttggcacagtaattttcggagctaacacccctgggctctgtctgcctaggctctgcccttggggtcagagacctctggttaaacttggcattgacttaggctcttggattcccagagcaggcacataacacctggactctgacctgactctgcaggcctaggtggcttgggttctaggcgtttaggtctgagaaatgcagctgggcctaggtatctcctcgttccccagggtgttactatagctgtg

SEQ ID NO: 264699 - DNA, 491 bp, Homo sapiens
tgggaggaagggcccacagtaggtgctcaatagatgtgtaaagaaggcagggaagcaagaaggttgctcaaacaagaccatgttcccagcagacagattgcactctgacccagatgccaccacacgaaacttacacctgcctggggaacaatcctgtgcttggctctccttggtggccagggacagttgtgcctcatccctcacttgcaaaccccagtcctgtctgacccagagaccctcacagggcatcagccagtgaaggcggtttggggctggaggatatgttctgatcttgggaagagcttggtaggagccagccacagaaagtttcagggcagaactgaacaggtctcgggaaggacacttcatgccagctagagaggctctgggcacaggaaagaattggacttcgggcagaaaaatgtttgtgctatttagtactatgtaacaaatcactccaaaacttcattgcttaaagcaacaagcatgta

SEQ ID NO: 264700 - DNA, 583 bp, Homo sapiens
aatggtaaattaacaaacagttcccagaaaccatctaggagttcttttgtttgggccgtgccataaaagcacatagaatatattacttaaaataatcttagaagtctactttatcccttttacaaaccaaaagagctttctgtgtgtggagccattgaatgcaatactgaaattaagttctttgatttataacagggccttttttatgtaagttagtacaaagtgaagataaaacatttaccaaaagttttgaatcaaaaaagaacagtgctttattggagagaaaaaaaattggcctggcatggtggctcatgcctgtaatcacagcacattgggaggctaaggtgggcggatcacttgaggtcagaagttcgagaccagcccggccaacacggtgaaaccctgtgtctactaaaaatacaaaaattagccaggcgtagtgactcatgcccgtagtcccagcactctggaggctgagacaggagaattgtttgaatctgggaggcagaggttatagtgagccgagattgtgccactgcactccagcgtgggtgacagagcgagactctgtctcaaacaaaca

SEQ ID NO: 264701 - DNA, 510 bp, Homo sapiens
atttgcatctgtcctattagttctgtccctttagagaaccctaatacagaagggtttcagttagaccacaagagcaaccttctgactgtgacctggaaaaaggcacccagggccttctgaaggaggagcagcttttacccaaggcccctgggcctgctccatggatttccaagtcaatctggttggaggcagagggccgccctagctcacctttagagtccctccccttggggaagaagagcccctaacaaggaagtgggaagcaactggctcttctcacccccgctctgggcctggtttaaatgaggtggtatgggggaggtaatagcacgtacttcacaggagcaagggacataaatgtgtaaataaatcctctaacaaagtaacacgcacatggcagatactaaataaacactagctattattttattttatttatgttttatttattttttaatttttttagacggagttttgctctgttgcccaggctggagtgcaatggcacca

SEQ ID NO: 264702 - DNA, 219 bp, Homo sapiens
ggggtctgtatccagaagggacacccgggagccccactccacacccacgtgggcgcggcacggggtctgtatccagaagggacacccgggagccccactccacaaacacgtgggtgcagcacgcacacacttgcacatgcgcacacatacacacacacaagcagggatccagagagagagcccaggaccagttgggagaggggcctgacaggaggggca

SEQ ID NO: 264703 - DNA, 452 bp, Homo sapiens
gaatgaaagaagaatcccaagttttgggcctgagcatctgcagaatggaggtgccatttactgagactcataagcctgggggaggggtagtttgagggcggagaccaggaattctgctttggatgtgctgattttgagatgatggctgacatgtccaagagtatatatccatcgcctctcagatagtacttcagctcttccaccctagactggagacccctcaagtgcagggactaccaaatccagggcagactgacttttaaccgtttggacacctaaatgctgaaaagatcaaggtgtcttatactacatgtaactcaaaatcaaaacagtattaaacacgaaacccccaaaataacatgttgctgtaatgaaaatggctttactctggattttctgaacgcaaaattctggatgatttaattaaatatgaacttttctctctgctttgc

SEQ ID NO: 264704 - DNA, 132 bp, Homo sapiens
gcagctacctaaccaatcttgctgctcctacggtccagcctccatacccacacctaagggtcctttttaaatcatccatcagaccactcttctgctctgcttaaagccctccccggcaggctgccacactgg

SEQ ID NO: 264705 - DNA, 312 bp, Homo sapiens
gtgaagcagaccattagcagataattgtcataatcttgatactaaatggagaccagaattaagttgaagtcagaaggcaaaggatcctttgatgtagtccattcagagcagaaggagaagaatgcagagtggatctgcagggacaaatagaagatgcagcgcaatggagatactgtttaatgccgcaggggacctgggctcttttcgtctctcctatgtaaagagaatttcctccatccaagtaaaactgatgcgatcggtcagctttctagacaacagaaataaataattctctctgtgaggaatgacaaa

SEQ ID NO: 264706 - DNA, 391 bp, Homo sapiens
aaatttaggatatgcgtggaaatggcctgtgtcagtcccacacaaattgtcctcaatcaggatgtaaaactggacaggatgccaaatattccctcatgtgtgatccatccttgccttgtgtgttaccatttcttttggagtaaagacctgagccactgaagcaaagctctggctttacactgtgttcacagcccccatttgtcctgtccccaatttgaattgttctagtaatgggaggaacagagtagccaagggaatattttccccaaatatggggcaagagaagaagagacaataaaaattccttatagatagagtcatttttgagagaatgaatttgtattctcgtattcttactaatgcataattgttaaagatatcatttatctta

SEQ ID NO: 264707 - DNA, 296 bp, Homo sapiens
gtccactgaattctcagtgagggcgcctgcccctcccagagccctgacactccggctttaggcagccctcggtgcctcctgcctggggtcccagcattgccgatgggagcgggagaaacattttggacagagccagcctggtgtggaagaaaaaagagttcccgacctgggagtcagctactggggtcccatcccaccctaagccattggtttgggtgtgatgacctccgtgccctcttccaccctgacacatgcagagtcagcccacagcagcaggtagtgggaccaccatgctc

SEQ ID NO: 264708 - DNA, 616 bp, Homo sapiens
tcggctcactgcaacctcccactcctgggttcaggcgattctcctgccttagcctcctgagtagctgggattataggtgcccacctccatgccctgctaatttttgtatttttggtagggacagggtttcaccatgttggccaggctgctctcgaactcctgacctcaagtcatctgcctgcctcggccttatataggggtgagtcaccccacccagccgatattctttattagtcatctttttcatatctattacagagttttctattctgaatttaatagtttgtttagctatcttttacctgttttatttaccgtcatatactgtgtgcttgcttgtggttggcactcaataccttctttccttcgtgtgagtggaagatgatgtcattctttgcatatttttgtaacccatggcttattttaccatgaaacaagctcttccttgcaatcatcctcacttcagagaatatttaacaatatactgttgtcttatagatgcagctcagtagtcctacattatcccagaaacacagattccctatgcataaaaaagcagtaatgaaagctaacttttttgagtatttattctgttcactattgtattctttaattt

SEQ ID NO: 264709 - DNA, 712 bp, Homo sapiens
ggaagggaggcaagagatcctgagtcttcaggatcatccatgacccagacaagaaagatataaaataaatcatcagcattatgaatttagtgttttgagatgctagactatgatataagggctggttagcaattctctctttatccagaaatacagtcatgtgctgcataacattcatggaccacatatacaacagtgattctataaattataatggagttgaagaaaacctattaccaagtatttactatactgtttatggttattttagaggttattccttctacttattttttttaagttaattgtgaaacaacctcaggcaggtccttcaggaggtattccagaaggcagcatttttatcatgggcaatgacagccccatgcattgtcattgaagaccttccagtgggagaagaggtagaggtggaagtcagtgatatggatgatcctgaacctgtgtaggcctaggctaatatctgttcatatctttatttttaacaaaaagttttaaaaaataaaaacaaattaatacaaaaaaacttatagaataaggatataaaggaagaaaacatttttgtacagctctacgatgtgttttatactgtgttatttcaagagtcaaaaaggttttttaaaaattagagttacattaaactaaagttaatttactattgaagaaagaaaactttctaataaatttagtgtaggcc

SEQ ID NO: 264710 - DNA, 339 bp, Homo sapiens
gagtctgtaagattttttaaaattttagcttttaatgaggacaagaaacttgaatcatttatttattcatcttgagctctaaactatgctaataactgggtatacatggctgtaaaataagatgaagtttatgtcttcacttaaagtttcattctagtagaggaaacatttaacaatcaaacctataataaatgagtatataattataaattatgataaatgctataaaaaaaactatgtgttccatgagaaagttacaaaagacaccaatttaaattgtttatctcacagagtagggctagtaacagtaagggaaaatagtattggtgaaaaagctgc

SEQ ID NO: 264711 - DNA, 433 bp, Homo sapiens
aaccactgcttgtcacatttttgtggtttttcggagctcccttgccttcatgtctgtatgtcttccacctgtagttcttcagattaagggcattgccatcttaccaggcctaagatggggcatctattagacattgcttctctgtaacccaccccctaagactgcctcttggttttcagtaccttccaggaaggcttcatgtgcaaaataggaatgtttcctccttcttcactttttcttatatttttttgtttgatcaagatggtatcaattcctacttcatcccctttagatgctctcctgtgcctccccactatatatggagttacttacattatcctagttctttttagacatatatgaaagcattattcaaaaacaagatgcctacagtttttaccactgaaaaacactatttcccctctactgctcc

SEQ ID NO: 264712 - DNA, 458 bp, Homo sapiens
cctttctggggatatttgatacattttttatgcattgcatgtattaatgccctaccagacatcttttttttttttaagagaaaagcaaacagaagtttattaacatgattaccttgtgaatacatgggagataactcagaaatgagaaaatctcaagagtagatctcaaagaggtggcttcaacttcagacttacacacttcattccccaacacaaagaatgaagggtgtaggccagacaaccctcattctctgttaagactacctggtgaagaagtgcagggtaaacaaaagtgaggtttgttatgcagattgaacttgtgctttttgtgttgataagagtttccagtgatttaggcctttaatcccagcacttagggaggccaaggcaggtggatcacttcaggtcaggagttcgagaccagcctggccaacatggtgaaaacctcatctctactg

SEQ ID NO: 264713 - DNA, 425 bp, Homo sapiens
cttagctgcgtcagctcataattaaacaataaaaggaggaattgttacttgcttggaatatatacagtcagttttctgtaaggtgggggcagtgtgtattttataagccctgttgctgtcccagttttctgtaagaagggaaatgtgggtattttataaactctcttcttgtctctgtcagttctaaaagactgagagatgacatgatagctgtcacaagaaatttctgcttaataacaatgaacactcagagctctttaggccctgaagaggaatgggaagatgatgagggaggaggaaataaaagcaagaaaatggtaggacaggaagattttttttttccgctctcaatcttgtctttgtttggctgaccatagagcagctatgtagaactatgtgtgtgtgtgtaagggggagagaagaga

SEQ ID NO: 264714 - DNA, 390 bp, Homo sapiens
ctcttacaggcagtctagggtccagaccagacacgatgagcatcccaacagaggcctgagttctgcgatgtaggcagaatgaccagagagacccagtttatctcatccggagatttggaagggaagaaaggagtccacatcaaagaaagaatgtgtacgcctgtgttttcaggattctgtctgcctctggtaaggaagcatctgaccgtgaatgtgccatggaagctttctcttcattaatagaagtatcattacaggagactcagttcacaagacagtatctcaagtgcactttgttctctgtagaaagaggtacccaataacatgatcatatacttctgtcacatagaaatgttgcaaataaatttttaataagttaaacagttaatt

SEQ ID NO: 264715 - DNA, 488 bp, Homo sapiens
caataagtatttgttaagaccaattttgtataatgtctttttctttggatgattttttacctgcatcttcaatggtcatagaaatggtctttcctaggggtttaaaacgtattgcaagtagagtatcatctggaatactcaagagatccaaaaagccatcagacattctttctctccgtattatttggaatcgtccaacttttaacaggctgtacaattgtcctttattttcctttctaattggaatttcaactaggaatgcctgtaggtattgaatgccctcacttcaaatgacttgctgcactaggcaatgataaaggatgcccatacattggcccaaaattgctacactgccatcatttttggtacgataccatattaaaacctatgtcttgagagacagtgacagtgcctaaaaataatggagatgagattttcccagcttttcggaggatcctgaaaataaaatactacttgccttctaaaaa

SEQ ID NO: 264716 - DNA, 671 bp, Homo sapiens
gagaaactctttctgtctaaatcttataggaagtcctctaattcataaaatgaggttctctgctttttttggagaaagtgagggggtacagagggactgggagccccagggcactgggagcctctaagtcacaaaatgcagtttgagagtcagtggactgagggacattggagtctctttcacttgcaacaatctcagacccttggctgagcccagtccagtttactgtggaccagctgtatgtcagctccatggctgtgcagctgagaggtggaccgggacagaggtcctggcccctttactgccagtgtgagagtcacccttggtgataggagggagtgcccacccttactgtacctccatgctactctcagaggttctctgtagcttcctgcccaagcttttaacttgatttgctttattagaatttttagggagatctcaaatggaatctgcgttacttcctaacactaagtgtgatttttattggaatatttgtctgaactaacaagctaaattctgctttgatggttgaatccctggacttaagccagcagccttggtttgaatcctggcatcaccacttgtgtgctgtgaggtcttgtgtgctcaccacttgtgtgctgttacttaacctgtgggccttagtttccccatagataaaaggggat

SEQ ID NO: 264717 - DNA, 433 bp, Homo sapiens
agaaaataagagtggatgttacctttaagcaacatacacatttaattaatgaacacaaggaaaatgattccggttgtagttaaatcgggtacaagcatacaggatttaagagatctgaccttagaaatgaagaaaatattattgtaattactccatttgctaaaaacaaatgatgtggcatttgaatttaagacttctatcaaaagcagttgagtgtctgtaatcagttctcacctttacattttaatggagttgaggttgagccgttgcatttacaattatctaggctgacttcatgcctttgaaatgacttaaaaagattagcattcatggattatttattagctcctcgtgaacgtatttccaagaatggaaacaacgtattgcatcaaagtctagtttccaagtttaactcttttaatgaacagcatga

SEQ ID NO: 264718 - DNA, 309 bp, Homo sapiens
gtcccctcctccagtgctgttggtgactttgctccatcaagcatcgtctttctctctctctgtctctctctctcatattctcccccctcaactagttgcttcctctctgcaaaaggaaaaaaataaaacaaacatagtcgagtttcccttaaatgaaagatgctttttctcaatcctgctattccctcaagctgttattgtatctcatacccttctgccacagttctttaaagtctagtccaaacgggtttctccaactccctacatcccagtacctactttaaataaataaaaagattaaacatacaa

SEQ ID NO: 264719 - DNA, 438 bp, Homo sapiens
atggttgcagctgagtatgtctacttacctcttggactgactcctcaccataaatgggatggccgttcaggaaatcttctgtttgctttgcacgctcctgagtataggacaaagcgctgttgtttaagaacataaataacaaaagctttgttcttccaaaccgagagggaaactgtagatctatccaaaatgacttggtcttaaactgcctaaggatgacaagaatgaaatattattttaggctgcccatcagcatccgtctctcaatctcctgtcttggcttcagaaaacaatgactcaatatggtctttttctgacacattgcagccttaggaaaatactgttccacatatttggaactagagctttccctgcattaaaataagtggaagttattcaaaagcccacttagctttctctctttgaatctgggcatag

SEQ ID NO: 264720 - DNA, 482 bp, Homo sapiens
gcttgagtttatagagcataactttgcaaaaactaaagctaaacgcagaatgaaaattggaattccttatttgtaagacagtttcactgagccttgactccagtccttccagccccatcccgcggcaggtcataggtgagataataaatgctgtgtctgttcaggtggaccaagaagaatttatttttaccatcccgctttaatacgcaggattattatttcacactctaagtaatgtgagaatgacatgaatagttcacatggtgtcaccatctgtcttcttttttaatgtcataagaagagtgaaaagtgtaattgttcttgagatttgttaggagttgactgtggtattgttgggagagggagctgatggttaaactgtctgcccatacataattaagaacaaacttataacaattgtttcatttttaaaacaattttatatactagtgttttctatctagttacggtagtaaaattgc

SEQ ID NO: 264721 - DNA, 1387 bp, Homo sapiens
tattaggactaccgattgtttgggtactccgaaacactcaggattgtggtgaccagttgaacagagatatgccaaaagcaggcagtgatttatatccctgcagaaggagtctcgccctgtcaccaggctggagtgcgatggtgcaatctctgctcactgcaacttccacctcccgggttcaaatttctcctgcctcagcctcctaagtggctgggactacaggtgcctgccgccatgcctggctaattttttgtattttagtagagatggggtttaggctggtctcgaactcctgagctcaggcaatctgccctcctgagctcaggcaatctgcctgcctgggcctcccaaagtgctaggattacaggcatgagccaccgccctcagccactatcttattttttagcctatctgaattaaaaacataaagtcttctctatgtatgttgatgataaactttgggtttcaaggaaaagagtcactcaggcaacttccaagaatgggaggggagaaggggttgttataggatacagtggaaataaatctgggaggaatctcaatcatgttccaagagcttgcaggggcccagagaaattctcacaatgaggcctcacaggaaaagcaagaacaccgacagcaggaaagcttggaggctaagagttcccttggaagttgaactactgcctgagaatattaaaacaaaaacagaaacacgtaatagccagccctgaaacgagcctctcaacttctgataggttatatttacatttatgtactttcctatcacagtttataatcaagctaaggctagtagccttgaatatttttagggctgcaatttgtacatcatctaagctaacagatgaaaagtgcaagtgtagttgcctaagcacaggtacattcgttcaacaacaaatctttacctgaatgtccattgtatgtccgacgctgtcctgtatcctggggtggcagcctggggacctgagaggactttgagtggagctaaagaaacagaaaataacttcaactaataaatgtcttttaatatctcttgcaatggaaattttcagtggcttaatttttttacttgtctacttcgaaggtgaagttactcacaggcaggtttcttagtttacagacttagcttttcttccactcccagcgtattatcatttatcaactattgtcattgaatgtccttacaccaggcatggtagatggcttttcagcttccaggcatcatgttgtgtctttttattcttcaatggtattgctttaaattgtaggcatccttgtaatgggttttcttctttttctgacccataaaaaatttctgataatatttgttgaactctgatcccattaaattaaaattttagttattaaa

SEQ ID NO: 264722 - DNA, 402 bp, Homo sapiens
tgtccttcttactcagtggttagaacaaatgccttgatagatgcccaaaaaacagcaagggacagttcacactcaggagctacaagtttaaaaacatctatactttaaaaatatttagaggccaggcacggtggctcatgcctataatcccagcactttgggagttcaaggcaggcggatcacctgaggtcaggagttccagaccggcctggccaacatgataaaatcttgtctctactaaaaatacaaaattagctgggcgtggtggcaggcatctgtaatcccagctactcaggaggatgaggcaggagaatcacttgaagccaggaggtggaggttgcagtgaggcaagatctcgccatttaactccagcctgggcaacaagggcaaaactccatctca

SEQ ID NO: 264723 - DNA, 97 bp, Homo sapiens
ggcaaattaggtcaaaactgactaaaaatcccatctggtcacctatactggctaagtgactatataattacccacataaacctttacatattgaaga

SEQ ID NO: 264724 - DNA, 389 bp, Homo sapiens
atcagtgtagtcagtcttaaaagtattttagaggtttgagatacaaagtagaacaattagctctttcctcactaacaatctttccaagtaaacaggtacttatttttatgggttggcactagatactgtccctgattggaacctagcttggccagctatccatgggactatataaggtaggtctggtataatcaatagataagaacatttaatttaattaatttatttattttttaagaaacagggtcttgttctgtcgcctaagctggagtacagtgacacaatcatagctcactgcagctttgaactcctggtcttaagtgattctcacacctcagtctcctgagtagttgggattataggtatggaccatcaggcctggataaatt

SEQ ID NO: 264725 - DNA, 335 bp, Homo sapiens
ctgtctgtttaggggacctgagaaaccagttagctttgcctcaaacactatagtaccagtcacagagcaatgatcaaggaaggagagatcagtgaccctctgcccagctcctagtcgaagtcaaagtggccatacaggatcccaacaaaagagggggcaagaaagactcttcccattggttctcttcatttcactttcagcaaacatgttcccaattcttccagctgccccttctgtcctcccctattgggcatccactaaacacccatgactcctggggatttcaaatgagcttataagctagggaatttgctattaaagattcctgaatctat

SEQ ID NO: 264726 - DNA, 1062 bp, Homo sapiens
ttccagcaggcacagacagacaagcatgtgctgacaactagcagaagcatctcatgcacaaagagcacctcgcatgccccaggccctgctctgccctttcatgtgtgaactcagggaattctcataaccaccctatcaggcaaagacaggggctgatattcctgtataaggaaactgaggtaggaaatgattaaattccttgcccaagttcaacttagctactaagtggcagagtttatagttgagccagcatggtctggctctagcatccatgctcttaaccaccactggagggtgtggctggggacttctccagtcattttggggtcatttagagttgttaaaagcatagaaatcatccagtctaatccccacaatttacaaaggaggcctcaggagaagtttctttctgtgattcaactgtttggtgtctgaatgaaggctggaacccaggcctcaggactttaagtcctgttcttttatgactgtgataccccagagtccctccttcctgggagtttcctgcctggggattcccatctctctgacttcacttgctctgggcagttggctctgtgcccttggtaaggcttgacctcttctctcttccttgctttgcctctgtttcactcagttgcctcatgcaggccttctcagggggctctttctgcaaaagcaagactgggttcgagagcagccctgctgggtctgtggcccttacccatgttccatgtcctgtcctggccagggatccaagagccaacagcatatcaggcagaaattaggcaccatgggtgcagtggctcatgcctataatctcagcaactcaggaggctgaggcgggaggattgcttgagcccaggagttcaagaccagccatggcaacatagtgagaccctctctctaaaaaaaatacaaaaattggccgggtgtggtggcacatgcctgtaatcccagctacttgggaggttgaggcaggacaatcgcttgaacctgggaggcggaggttacagtgtgccgagatcgcactccagcctggcaacagagcaagagtccttctca

SEQ ID NO: 264727 - DNA, 755 bp, Homo sapiens
gaatcaggcctgagctggctctgatccctctcccttctcctaatcactgccctggctgcagaactctgggctggcaccagaatagcagccaacatttggctgacacaggacataatttttaatcatgggaaggcagacataagtacaaaaggcctattttcttcacgcaggttcaagtatctgcttttgggttatgtctgtctgtatttggcagggctggtcttggggaagttccgggattcgtgaacaaaaggtcagtctccttccttttccaggatggaagcggcacaaattgttctgatcagggagcaataacatgcaacgatccccagggctcccaggcaggcggagggggcacccagtctcagcagcccgcgatctgcttggcccctgcgagctgcatgcctcacatttccccagctccagcctcctttcaaaggccctttattaaaccaccaactatttgctgtcgagacatttaggatgaaatcattgtgttaaacaaataaacgcagcttcgtccagatttctgctctgggagcagagtaagaaaataatttctgtctgctcgccacaaaagcggctggaaaggtccaaagaaaaatattatttttactccattgtgtgaaatattgtcctggaggatctgacgggctgagcgtttgaagagtttgtgctggcaggtttcaagggtcccctgggtcggccccctgggattgttttctgcattaataaactgagcatgatgtgtgtta

SEQ ID NO: 264728 - DNA, 462 bp, Homo sapiens
cagggcaggtacctggcattagatggggcaaacttggtgaagtagaaggcggtatgactaagggctgctattttggacccagtcttcatgagttctgcaaggttttaaagtcctgtcccctcaggaagccactggattgggcttagcatctccctggcaggataaagtaggcttgcctggagtagcagctggaaagggcattacggtgcatgaacccagccaacccattccttacatggggaacgtgcccaggtctgctctgtgatccagtcttacactggaaagctgtcaccaggatgaggtacttccaacggtgggggcctctgagcacttgcctgagactgtagaggctcaccctgagacagctgctcatttcacaaggccagcctgcctgctgggaagtagtagcagaaaacacgctgcttgccagaccagcagccccaccgctctgaagaacttttt

SEQ ID NO: 264729 - DNA, 443 bp, Homo sapiens
tccccttttctcttagattttccctgttgaatccttaaatactgtgtgagccttgaacttctgccgtaattccgtattattttataggaccccttctgatgagaaggcatcgggaaaagggaaacgttctgtaatcctgtgcttagatctctctagtgagcctgtgccacttggctgtgaccttcacagctgtttctcaacttccccgcatcccctccccgcccccggctaccaaattgagacaggaaggtgtgagcgggctggagttgggtatttccatcagttcctgttggtcaggctctggtaaatcccaggtagcctaggctctgctaaatcatttctctgtttgttaaggagagcagaatgctttgggcttcatggaaggggagaagagcaaccactgtgaaagaagccgtcgacgcggccgcgaatttagtagtagt

SEQ ID NO: 264730 - DNA, 4517 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaggatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggccccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaagaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattccttctttatggagccaatgtcatttaggaagagccctacaactgaggagacagtacttaccaagacatcgttgtctttacaggaaaagaaaattactcagggggagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaaaa

SEQ ID NO: 264731 - DNA, 1525 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatgataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaaaa

SEQ ID NO: 264732 - DNA, 1205 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaaaa

SEQ ID NO: 264733 - DNA, 4517 bp, Homo sapiens
agcggggtgggattacgcggcgtgagccgccgtgtcgggctccagctcttttaagatcgtctctctgctgggattggtttattgtgtcatgaatgcaattgctggtgaactggagctgtgccatgtagtgaagtgttaatggtacaggtggagaacagagcaaatggtctgatcccagtgtcctgcttcacattataacagctctctgacacggacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaggatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggccccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaagaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattccttctttatggagccaatgtcatttaggaagagccctacaactgaggagacagtacttaccaagacatcgttgtctttacaggaaaagaaaattactcagggggagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaaaa

SEQ ID NO: 264734 - DNA, 388 bp, Homo sapiens
ttgtgattctatatacaccaacagcattctctgttttcgcatcttctgtgccatgtttctatgttgtttgaggtatacagaaatccgttccacatgcactcatatacagaccacaaatttagtggagacagtatcactgaacagcaacaccattgcataagtgtcttcgttgttgttgttgtagacaggggatctcactatgttgcccagactggtctcaaactcttgacctcaggtgatcctcctaccttggtctcccaaagcaatggaattacatgagccaccatgcctggtcacataagtgtctttttatccttccatacacataattatttttgaaccagtgagaaacttatctggcttcttcaggcaaatgaagctttaatta

SEQ ID NO: 264735 - DNA, 318 bp, Homo sapiens
caagtggcactgcaggaaatagtagccttgttctctgtcctcaagttgttccaagattgcagcccacaccagtgcttgggcttgtgagaatggagggctctccaacagttcagaaacaagcagtctgccacaggggtgagaggagcaaaagacacccccacctatgcttttccatggaacatcaagtccctcagagtataatctctgctggatttttgcttccttatttttctgtgttcaagtttcttcttgtggtgctctagcactcccgtcaatatagatattggaattaatgattatttatccataactttgctt

SEQ ID NO: 264736 - DNA, 279 bp, Homo sapiens
actttataaagtcaattcacaaagtagagttcaacaattatttaattcaatgatttaatttggtttcatcagatacagagatagagtggtatgtttgatgatattgatgattattactgttgtctagaaatacttaaattgatgtttatgctttaattaactcagaagagtacctttatgtcagttaataaaaataaataatcttaaatgataaatcagaaatattaggaaagcaagactgttttgtacttgggtgtgttgaaagaacatgtatgatga

SEQ ID NO: 264737 - DNA, 730 bp, Homo sapiens
gccattgtaccctgcttgtggcaacttgcatagttggttaaactgcactcagtacttacatgatgctgggaacacagcagggaccaagacagccttgtgccctgcctgactccatgggactcacagtcctgtgtgtgtgtgtgtgtgtgtgtgtgtgtgtgtgtgtaggggtgacagacccatccatcaccagacagtgactgattattaggttaatgcaaaagtaattgtggcttttgccattaaaagcaatggcagaaaccacaattacttttgcaccaacctaatagatttgtctgggctatgaagggggaaacacaggcagaggggtcagggctgggatgagggaagagtaggagctgtgggaccctagaggagatacctgactcaggtcagggaaggtttcctaggggaagcaacagctaagctggatcttgaaggatgagtaggaatcagactattaaacagctaatggaggctgggtgcagtggctcacgcctgtaatcccaacactttgggaggcccaggtgggaggattgtttcagaccagcctaggcaacatgactctacaaaaaaattaaaaaattagccagatgtgatggtacatgcctgtgatcccagctccttgggaggttgaggcgggaggatcactatagcccaggtggtggaggctgcagtaagctatgatcgcaccactgtaccccagcctgggtgacagagcgagatcctg

SEQ ID NO: 264738 - DNA, 466 bp, Homo sapiens
acctccacctccccggttcaagtgaatctcctgcctcagccacccgagtagctggggttacaggcagcactaccacgtggacccagctaatttttgtatttttagtagagacggggtttcaccttgttggccaggctgatcttgaactcctggcatcatgatctgcccgtctccaaaataaaataagtgggaactatgctacacatggacatattgtgtggaataatagacaagagactaggaagggtgaggagggggatgatgagagattacttaatgggtacaatgtatgtgatttgagtaaatgatgccctaaaagtcctggcttcaccactaggcaatctatgcatgtaacaaaattacacttgtaccccataaatttatacaaattaaaaaaaatcaggctgggtacgtggggtaggaggagcaagcgagcaagcagcagttcgtggggtaggaggtggga

SEQ ID NO: 264739 - DNA, 620 bp, Homo sapiens
acctccacctccccggttcaagtgaatctcctgcctcagccacccgagtagctggggttacaggcagcactaccacgtggacccagctaatttttgtatttttagtagagacggggtttcaccttgttggccaggctgatcttgaactcctggcatcatgatctgcccgtctccaaaataaaataagtgggaactatgctacacatggacatattgtgtggaataatagacaagagactaggaagggtgaggagggggatgatgagagattacttaatgggtacaatgtatgtgatttgagtaaatgatgccctaaaagtcctggcttcaccactaggcaatctatgcatgtaacaaaattacacttgtaccccataaatttatacaaattaaaaaaaatcaggctgggtgcaggggctcatgcccataatatcaatactttgagaggctgaggcaggaggactgcttaaagccggaagttaaagactaggctgggcaatatagtgagaccccatcctatgaaaaaaaaataggaaataataaaataatttttacaaaaaacaaaatataaacacaaaaaaagtttttcttctagaaaaaataactaatttacatctcaa

SEQ ID NO: 264740 - DNA, 589 bp, Homo sapiens
ttagtagagacggggtttcaccgtgttagccaggatgttctcgacctcctgacctcgtgatccaaaagtgagacctcggcctcccaaagtgctgggattacaggcgtgagccactgcgcccagcccaaaaaatgttttttaaatttgtctaggattcgctcttgggcactaagtcatttggggagggtttgtgatttttctccctctcagaagaactatcataggaagaaatgaagaaacttaagagttccttcctcatactgtttagattttattcatccaattggcacccaaaatccactacataaagactttgagtgctctgatttaaagaaatctatgagatgtatgagtgagaaatggtccaccgaggctgagctgctctcagtggagctccttatcgtagtgacaaaactcaggacaaaactccatctgtgttacaaccacctcagggacttttggttacacgcagttgtcagaaataacaggactttggtggaactgcctttctagaaaaggagcagtgaagtgttaaaaccagtctgctttctctcagttgcacagctgtgggctgaccaggtgtcacact

SEQ ID NO: 264741 - DNA, 360 bp, Homo sapiens
tttttttgagacggaatcttgctctgtcacccaggctggagtgtaatggcgcgatcttggctcactgcaagctctgcctcctgggttcaagcgattctcctgcctcagcctcccgagtagctgggactacaggtgcctgccaccacccccagctaactttttttttgtatttttagtagagacggggtttcaccacgttagccaggatggtctcgatcttctgacttcgtgatccgcccgcctctgcctcccaaagtgctgggattacaggcgtgagccaccacgcccggccagctccagttatatcattataaaacaaccagaactgaaagtcacacagtaattagtgttgagtttggc

SEQ ID NO: 264742 - DNA, 501 bp, Homo sapiens
cttaccctcttagagtacagctgcaggttataacaaggcttagctgcagcatggcattaacccctcagcaacaaggtgtccacagtgtatgctgtagtcatccagccccttctgttttggtgtcatcattttggtatctgagacaaaagctcatggagagctggcacttgcttttgctttcaatgtctgtgcaaataataatatgtttaaattcaaaaagagtttatttttttaccagccaaattttttaaccttgccttgataccaaacatttgattcattaattaatggtaaaacgaacaaaatgaccagacagatactacctgggtaccagagataatagagatgaataaaatgaagtcatgattccgtctctgtttttccctttaaaagagatgagatctcactttgttgcccaggctggagtgcagtggcataatcacagcttgctgcagcctggaactcgtgggaggatttcttgaacctgaggggttgaggatg

SEQ ID NO: 264743 - DNA, 428 bp, Homo sapiens
ggtggcgagttatgaatgactacagcatcacaaaacaacatacctgctttcttggtcaccagcacttcttccagacaggacctacatcattatatccagaaacattctgtccacaggagagagtggagattctctgccaatgtcttcttgtctcctgttgaaactggttgaagtttgtcccttagagaactaattaattcaccctcacctccaggttctgttactggctctttatggcaactgctagggaacccagatcccccagtgattggaggaacctctgaggatacagactgattgcacctgagcaccaaacttgtgagtctccttctaatgcaatctcagtggaatccagtcactgggagaggctgaggtcactggcacagttgggatatgaggcactggcaatggcaatggtggcttgggct

SEQ ID NO: 264744 - DNA, 378 bp, Homo sapiens
ctgcctggcatctgcctgtaaaggaagcatggcaccagcatctgctcagcttctggtgaaggcctcaggaagctttcaatcatagcggaaggtgaacggggagcaggcagtcacatggcgaaagcaggagtgagacagagagagtggtgtaggaaggtgcagctcactagaactcactgattatcacaaagacagcaacaagccatgagagaaacaagccataggtccccctgacccaaacaactcccatcaggactcacctccaacactggggattgcagttcctcatgacattgggtgggaacatacattcaaactatcacgtgacaatattacttccctcagtttattaaagaacaagtgtttctagctcttcag

SEQ ID NO: 264745 - DNA, 478 bp, Homo sapiens
gaggagaacgatttctatgggattctcaaagtaaatgggcaattttcatgcacatggagaatctacttctgcagactgagttcaggccagacctgctctgtcaaagcccgacagagagacccgagatggtgagggcgggagagggacagcggaggaccgtgctatggcttgagtgtgtttcccaaagttccttgtgttggaaacgtaatccctcatgcaacagtgtggagatgtgtgatctttcagtgattaatggatgaatgtgaaatgaattcatgtcattatggtgggagtgggtctactataaaaacaaagtaagccccttcttaccctctctcacgcactctctcaccatgtgatgccctatgccacattatgacacagcaaaaaggccctcacctagtgcagcccctcagtcttggactccccagcctccagaaccatgaaccgaataaacctctattgtggataaattact

SEQ ID NO: 264746 - DNA, 402 bp, Homo sapiens
tttccactacagatgtatggaagtgccaatttaaccttatgcttggtccacgtgtggtattagtataaaaacatcgccacccagatttttcaaaaacttgattaccccagacacccaatcctcaccgtgcttgtaggatacttactttatctctgaaatctttgaaattctatcaaaatctctttgccttaaatttggctaaaacataaaacgtatacatttattttttccttttcttctcttcctgccccttttcttcatcaacctagttttcttcattcacttctttggttactgcttcagcttcattggttctagaatgtgagcgttttgaagacacattccgtatctcccatattctctgttgtatcatggccatagtatactagatgctcaataaat

SEQ ID NO: 264747 - DNA, 561 bp, Homo sapiens
gaccagttttaaatctcgtgttgagagccggaagatgctggagaaggaatgtggtggaatgactgcctgagaatgaaccattctccagtgagagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagctcttccagcaggattagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaaaaac

SEQ ID NO: 264748 - DNA, 551 bp, Homo sapiens
catcttgtaggttacatttgcatgaagattaaagagttggttattctatcatgtagattttattatagtattacaataatgctgccatttattttaaagtaaatataacaagttactacttttttgataaggaaatacaatgtaaaaatgatgtttgatgattacaaatatgattactgtttattaatttatttcagtcagttacagaacaaaacatctagatctctctgtaacttccagtgttacagtctacaaaggaatttgatttctgttgagattaggattctgattattgagtaaaaatattttatttaaaatttcaattggttctgtatttcttggacagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaaaaac

SEQ ID NO: 264749 - DNA, 841 bp, Homo sapiens
gaccagttttaaatctcgtgttgagagccggaagatgctggagaaggaatgtggtggaatgactgcctgagaatgaaccattctccagtgagagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagctcttccagcaggattaggttcggtaggaattattgaatataatataatataatgtaaaatatcggaattatttttcttaggtgcttagtaaggagggtattagattttaatcatatatgtgttatttctttaaatcttgccttaatttatattatttaataagtgaagatttgctaggcgaatcttagtgataaattaatacttaatgttagttactatttgtcttacatagagttcatttctatgaagacacgtgtttcaaaacgtatactatatgcctttgtcttggctgttgaaattctgtgatgctttatatgcatatcacatcctagagcctggcatagagtaagtgctttaaaaaatattggttgcttgtctaataagcttacagtagttactatgtcgagagattacagttcaagttgggaggttgataataagtgtgttagcatattttataatactaatattattattaataaagctaccattagtatctaca

SEQ ID NO: 264750 - DNA, 535 bp, Homo sapiens
ttttctagctttaaaacatatttcctttagatgtcctgggataaaaaagacagaggtcatgtacccgttttgctttatatttaataaatctaaatagaatcaactgctaatcatttccttttacacctaatgcttttatatatacaaaattattggatcaaggcaaaggattctataaggtagggagtgattccctaagttgggctgtgtatcagtgtcacttcttcagacatacagatgcctggtataaaagttggtcacatgaattgggtcatttttatcatatccaactaaaacagtcaattggccagggggaaaaagcattcagaacacataacattgatcaaagaatgcaattctatgcaagcctggttgctgaaactgccttctgtaacctgaaattggtttttctaattactgaaacaacctgctgtgactctaagactagttttacccaaggctgtcactcaccaatcagaagttgccagctcccccaaactttactagtgccaataaactttcctacaaaataata

SEQ ID NO: 264751 - DNA, 317 bp, Homo sapiens
ctttatagttaaaacgcttagcaaaattgacatagaagaaacataccttctatgtcaaggtagtaaaaaccatctatgacaaacccacagccaacataatactgaatggggataagttgaaagcattccccctgagaactggaacaagatgaggatgcccatttctaccacttgtcttcataatagtactggaagtcctagccagagccatcagacaagagaaagaataaagagcatccaaattggtagagaggaagtcaaactgtcactgtttgctgatgatatgattgtatacctaaaaaatcctaaagatttct

SEQ ID NO: 264752 - DNA, 439 bp, Homo sapiens
ttccttttgttcttcagaggaaataatgaaatgcattcattttaagggtgacagaaaataatttgttttttcatcatgactatcaatgttattcactcatttatttattcattgattcattgctcaaatatgcattgagtgttcactatgtacaagtcactttgggagctgcaagtttagcttatacatgaatttttcccttggggagcttacaatctatcagaaaaagacaaatgtgaacataagttaattttagtgttgaaactgttaggtgtaataagtacattaagacagagttttagagagaactcacatttggcttaaaaatcatcaaaaacacattatagaagttttctacacttgaatggggtcttgaagaatgcatataatttaaatgtgtagatatggaatagaatctacatattttacatttttcact

SEQ ID NO: 264753 - DNA, 408 bp, Homo sapiens
ctggtgggtgacaggtaagagatggtgtaggacagacaggatgtcacaggctagtacttcccaaattcacacctgtcctaccaagccaatgcagttattcctttttcattccttttctatcctcttaaagaaaactttgatggactttttgtttgatggaatcttagactgccggttgtctatccttgttcagcccctcttgaacccttgctaatttcttttgttgtggatgagagcatttgcttccatctctgatcctttgatagatcgttgcatttcaactagaatttaattataggtctgctgtttattttttgactatcttttatttcatttaattagtaatactgttttttatctattaatgtttagttatataatatttccttttacatttatttttagtaa

SEQ ID NO: 264754 - DNA, 346 bp, Homo sapiens
attacctggattttttcatttcctgtatgtaactacaaactcaatcttatttttaatgagtcatttctgtacagactgtaaaaaaatgatatcctagaatatttttcgtcattcacattttgcagccaattaagttaaagcaggaggattttcaaatggtgataactgttatgcaggggttttgtgaaggaggtaacttgagctgaatattcatctgcgtttttcctgctgatttttgatctttgctttcagcaaggccccacattatttcagtgtcattcttcttatatctaaactgaataatataaattttacaacaaaatgttcaaaacggattggtgctttt

SEQ ID NO: 264755 - DNA, 168 bp, Homo sapiens
tttcagctcctggcgagtttctgacttccctctgccgagatttctttaaggtaataaaagtttttgccagcgtcaacaactaggccaccaacaaaagatctgaaaacaagtccacagcaacaactgtaatagtgattcttagagcagtggcgataacgccagcggaaa

SEQ ID NO: 264756 - DNA, 245 bp, Homo sapiens
gcttttccaaagtgttttctcctgtaaaacctctttataatatcctctgcttattactagatctcatttttaactctatgttatgtaagtaaatatctatgtatatttgaggtataaaacttattctcttaagctttttccatctaattttcttagtgtccagtctgtgcctttgggcatcctttattaaaatgctttaatattcttccaaaagtttctcctcttatgatcattcagttattaat

SEQ ID NO: 264757 - DNA, 732 bp, Homo sapiens
agattttacaatttaattataatatacgtacacttaccgggacctgaaaaagctattaagggtgtggttgtgatggattctgcattggaggcactcccaagtagctacttgttggaaaggttccagaaatatgggccaaacgtcatacccaagccttaagccctggggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagttt

SEQ ID NO: 264758 - DNA, 779 bp, Homo sapiens
agattttacaatttaattataatatacgtacacttaccgggacctgaaaaagctattaagggtgtggttgtgatggattctgcattggaggcactcccaagtagctacttgttggaaaggttccagaaatatgggccaaacgtcatacccaagccttaagccctggggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaacc

SEQ ID NO: 264759 - DNA, 406 bp, Homo sapiens
atatgtctattttccaaagatcattttggtttctctgtatttgtaaatgcacttgattgtaatcacaaaagaaaagacagtgatgcactgtgttggctctgaagaaaaacattgaccagacagaaagtcttccccatagccaaactgagctgtaatgaccgtgcttttcatttctcccaggaaatagtaatataattggtcactgtattacagtaaacagtttgttcattctttgttcagtagaaaatgtttgggagatatgtctcacataatatgctggcttcacgataataaagactgggaatagatttgtttctaaataaatctcaataaatacattggtaaaatgaacacagtaggaagaataaacaatgcaattaggaatatcttaagtacatttacatgt

SEQ ID NO: 264760 - DNA, 492 bp, Homo sapiens
cagccctgctgactctcatttccttatttccacgatgggctgtgtgtcaatgtggcccttctcaggatagcactatcaatgaccttactcgtgggccttccgctgggaaataggaggaggctgtgtgtcctcaatgtccccttggtatcactgctgattcactgagctaccttgtgaggggatgcactcatctcaagcccatctcctcttttctaaaatggaggtgagttgctcctgtctgagatctcagggggaattgaaaagagtttggagatcctctgtgaatacttataaaaaaagctcttgcttcaaaactagaagcatgagtgtaaaaaagaaaaatatggatgctgaacacactggaaccaatacatccaaaagaacacagtccttgtcaaagtcgtgcctgtaccagccacacctcatcccctgcccttgcttgcttaccaggctttgagaaacaccttttagctagtttatcagcagataggc

SEQ ID NO: 264761 - DNA, 346 bp, Homo sapiens
ctcactaactcataaggaggttgttccaatttgaaaagaaggccctgcactgtgtagatctgaaagtttgactcaggtgccagtccagcagctgggggtcatggagaacccacctaattacatgctctctcatgtgtaacactctgaatggcatggactatatatatatatatataattgttttatatatataattcttatatatatacatacatatataaacatatatgtataattgatgaatatgaatatttatgaaattaatatatataattgttatattacttgaactcaaaattattcttctataaatgtattctacagcaatatttggacaaaaatgtaa

SEQ ID NO: 264762 - DNA, 715 bp, Homo sapiens
aaccgcaggtttttctatgtttagatatgtttaaatacacaaatatttatcattgtgttacagttgcctacagtattcaatacgataaatgctgtacaggtttgtagcctaggagcaataggcaatatcatatagcctaggtgtgtggtaggctatgccatctaggtttgtgtaagaacactcttgtacaacaacaacattgcttgatgcatttctcagaatatatccttgttattaagcaatgcataactgtatttggtaaaatacagagatattccacatattttattatgctattaagcatcgtttaaaataatttatgtcagttataacttgtttattctttcacatgaacattgaaatcattgagtttacttcttaagcatttcattggtatcttcatttaaattgccttatgtttatgttatcatactaataaacaggttttcttttttgggcctcagtgaagtttggtagttttcattatataagatgttttgcatttcttgttaggatgtttcttatgtattgcatgtttctgattattgttaaagatggaacttttttcctgttaaatttcttaagtgattactgttgagatctatgtatatctattttctgtatcgatgtcaatatctatatctatattgctgatttttgtatcttcttaaactaattatcttactgacttctactagtacattttcattttgtt

SEQ ID NO: 264763 - DNA, 465 bp, Homo sapiens
ctccattcttgtgacagaacaggtgtgggcgtgttcattgacttccaacccccttcatgcatggctgacgcatgggatgttgctgtcatgcacgtgtaactgaatggagggttccctcaggtgttctaggcaatggcacgatattagagacgccctgaggcagaaaaaaattgatgcagctgaagtgaagtgctgtcagtttcacctgtgtggagctcgttgccatagcagtggttacagtaaaactgggtccagaggatgtgaacgagggccaggagatgtacaatataaggcagaaaaatggctgaattgttatcatactcttaaataaggaaagccaaaataaactgctttattgggtcttggctaattaaaaaaatagaggtttaaggatatatttcttaagaacataaaaggtaatcattagtagaatccaaaataatatgtacaccccaagctaactgg

SEQ ID NO: 264764 - DNA, 451 bp, Homo sapiens
aaggattgtaataatcaaggaataagcaactgaatagaaaagggtctgttttaaggtaggcaggcctgtgcaaacctatcccctaaatcagaggaagctgaggggctgaaggaagaagctggcaaattcagtttctcagaaagaaacacttaataaggccttgccaacagaagccctgtctgtgtcttggatggtagcgagacaagatggtggatccccagactcagggcttgtatacatagggaaggggcatacatgcttcagaagggatgtgcagaacaattgcttagggtcgggatctatggtaagtaagagaacatcaaggctgtttcaccaaagggcaggatttacgtgatgtacgtgctcttacacaagaaacattagataaaaccagagatcttagaggcttcccccaaaccggagttagtgagaagtcaatatggcagattag

SEQ ID NO: 264765 - DNA, 827 bp, Homo sapiens
ctaggtcattggttaactatgcctattcaagaaagttgtttctattcactaacgtgagagcaccttaaaatgtactgctgtgtgtgtgtgtgtgtgtctgtgtgtgcgcgcgtagctttagaaactatatttcacctgtagaatgcatctattgcttataataacatgttaaagtagtgatacctcagaaggattataacccattgtcctacagattttctaatgtagattagggaaggaaacccagctctacttttgcaaactatttaaagatttgcaacaaaattaattgattaaaatcattaactacagatattctcgggcattttttctggtcagttttatgcacattgagagtgtatgtgccagaaacaggagctgattagaagaggttttcctataggatgaggtttctaaagtccagtaaacttgagcatgtggagtttctccacatactgcttttcaaaactgtagtgatctgtgaagtaaatataattctaatgcccagaagagcattgagcctgtggactttgactctttagaaagggaaccagcgtctggggaatatggtggggtactagcagtaggttagagctttaaaaatcggtgtcactggctggatgtggtggctcacgcctgtaatcccagcactttgggaggccaaggcaggtggatcacctgaggtcgggagttcgagaccagcctgaccaacatggagaaactccatctctactgaagctgaggcaggagaatcacttgaacctgggaggtggaggttgtggtgagccgagatcaagccattggactccagcctgggcaacaagagt

SEQ ID NO: 264766 - DNA, 535 bp, Homo sapiens
gagcggtcatgttggctgcgccgaaagtttgtgatctaggaatgaactctggtttggccgagggagggcgcagggggcttgaaaggcagagtacgtaacacagtaaaggatcagaaccccctagtaatacaacagcccacaaggccatgctgatgaacgaatggcaaaggaggggaagtctttcttcccagcacaaagtcaatccatgatcatcagagtgacagaatgagaagccaccatctggccaccatcacgatcatcatcacaatcacgacgagtcaccaagagactaaaactactgagtaaaagcttagaaacggccgggcgcgctgggattccaggcgtgagctgctgcacctgcccataataactttctcgccaccacctacttcagtttccctcactgctgtaatattcagctacctgagctgggccttgaggtccgagttcatctccagctccagaagaatctaagaaggcagacaccagggtcaccctcagcgcgtgtattccaaagtcctctagatgactcgca

SEQ ID NO: 264767 - DNA, 587 bp, Homo sapiens
gagcggtcatgttggctgcgccgaaagtttgtgatctaggaatgaactctggtttggccgagggagggcgcagggggcttgaaaggcagagtacgtaacacagtaaaggatcagaaccccctagtaatacaacagcccacaaggccatgctgatgaacgaatggcaaaggaggggaagtctttcttcccagcacaaagtcaatccatgatcatcagagtgacagaatgagaagccaccatctggccaccatcacgatcatcatcacaatcacgacgagtcaccaagagactaaaactactgagtaaaagcttagaaacggccgggcgcgctggctcacacctgccatcccagcactttgggaggctgaggtgggcggatcacaaggtcaggacatcgagatcgtcctggccaacacagtcaaaccccatttctaccacaaaaaattagccaggcatgatggcgcgtgcctgtaatcccagctactcaggaggctgagccaggagaatcgcttgaacccaggaggcggaggctgcagtgagcggagatcgcgccattgcactcctgcctgggcggcagagtgaaactc

SEQ ID NO: 264768 - DNA, 902 bp, Homo sapiens
aaagcaaaatcccgggggagcaaaatggacgaaaggcgacccccaggcaggggcgctgggtgccttgggaatccgaggaatcccttctctttgccagtcggaggggactagagggagccgaaggggccggagatgggccgagcgctgccccccgggggtcctcggcgccgggcgcagcttacaagcgcagcgcagcgcagcaggctccattcccggccgccgccgctcagcccattgcgcaaaccaaccccgctctgccgccgctgctggaacccaggaagcgtgcttggaggcttcgggcactacgcggggctggaaataccacgcactgccccttcgcctagacccccgctccggccacgcgggctctgccctcaaagctggtggctgcctcagacttggcggtgggggaggggaaggggagaggctggcgccccctcccccttttggctcccgcgctcgttgcagcagctgttgccaaatgaaccccagaatggggacgtgcaaccctccaccccacccccagccacagacgtcgcggtcagaaaactgggaagggggcgctgggtccgaggttctggaaaagcaagaactcacctgcaaacaggcagtccttctcagctctggacttctggatcacgacgtcgatatccttctgaattcgctcttgccttgaacacatccccacaccgacctccactcgcgccgggagctgagcggtcgtgaagactccctggggctcccagccttccctctccgcgcccctccccccatcacttttatgaattcgactccactttctaaaggaattatagtcttgtggctaacccaaaccggagtggctgggagggggaaaaggggggaaaagaaaatctttaaaaattaaaaaaataataaaacga

SEQ ID NO: 264769 - DNA, 1528 bp, Homo sapiens
  misc_feature (727)..(727): n is a, c, g, or t
  misc_feature (732)..(732): n is a, c, g, or t
  misc_feature (737)..(737): n is a, c, g, or t
aaagcaaaatcccgggggagcaaaatggacgaaaggcgacccccaggcaggggcgctgggtgccttgggaatccgaggaatcccttctctttgccagtcggaggggactagagggagccgaaggggccggagatgggccgagcgctgccccccgggggtcctcggcgccgggcgcagcttacaagcgcagcgcagcgcagcaggctccattcccggccgccgccgctcagcccattgcgcaaaccaaccccgctctgccgccgctgctggaacccaggaagcgtgcttggaggcttcgggcactacgcggggctggaaataccacgcactgccccttcgcctagacccccgctccggccacgcgggctctgccctcaaagctggtggctgcctcagacttggcggtgggggaggggaaggggagaggctggcgccccctcccccttttggctcccgcgctcgttgcagcagctgttgccaaatgaaccccagaatggggacgtgcaaccctccaccccacccccagccacagacgtcgcggtcagaaaactgggaagggggcgctgggtccgaggttctggaaaagcaagaactcacctgcaaacaggcagtccttctcagctctggacttctggatcacgacgtcgatatccttctgaattcgctcttgccttgaacacatccccattaaataaatccctggaaaagaagcagccgctatttccancccancccanccccctcgcacgcttccagctttcgtaaatattcagttaaaaatgaaacctctggccgaggcaggggctgaaggcgaagtggtttcggaagtgatcctgggtgagaaagaggaggaggaggagggggaggaggaggaggagggggaggtcggctttgcattcccagatgtgaccgcccagctgctgctcgccgctgctggattccaatttcctccccttctgacaatggatggtgatgacaccaagtctcactttctccctcacccgcccggaccaacggccgtgggggccgaggtgccggggacagccagagagcaatcaccggctgggcggcgggcgccggcgaggggcgagccccgctccggctcacgcgcgcacacccctcacggctcgcacgccggccttccacacccgcgcacactcgcgcccgcgggcggcggcagccgtgcccaggctgctgcagcgccgcccgcccgccgcagaccctccgcgcccgccgcctagtcaccccgccggccgcgggctgccggggctcgcagagtattagccatcccgggcgggagccgcttctccccacaccgacctccactcgcgccgggagctgagcggtcgtgaagactccctggggctcccagccttccctctccgcgcccctccccccatcacttttatgaattcgactccactttctaaaggaattatagtcttgtggctaacccaaaccggagtggctgggagggggaaaaggggggaaaagaaaatctttaaaaattaaaaaaataataaaacga

SEQ ID NO: 264770 - DNA, 416 bp, Homo sapiens
ttttatctgcttataagatttttaaacattggctgaaattgttggaactgatatggccaaatgaagtccatgaagaatcagattgcatatgttagagcccaaatttccattgtgtgtttcatactaactctccctgaatttgcatgtgacctgagaggaagcaagaagagatgactgtatatgtctcatgactttccatattcctactttccttccagcaatcccttacagaacccacctcttaggccttttctaatcactgtcttaaagccagtataaaaaaacaaatttcagctggactgctatctccttgttggccaacctacaacatgatattttcgtcaaaacccaagggccatactactgtcatcaggcagtaggccattttattcaataaaaaactgagtcactaacca

SEQ ID NO: 264771 - DNA, 534 bp, Homo sapiens
gaaattcaggaataaaggaaaagctacataagtggtagatatttagataaaaatcaaaggcattttttatttttatttctttaaaatatatatgactattgaaaggaaacatttggtgggcttttcagtgtatgtagatgtaatacatattatgattataacaaaagataattggggaaggataaagaggcatatacaataatatatttaaaggtaaaatgatatttgtaaaatctactatttggaaatcatcatactttgaagtaactcatgggtgaaagaggaagtcccaaaggaaataaggaatatttagtatagaatgtacattaaaacataacatgctcaaaattatgggatgcagctaaagcaatacttagaggaatatcgatagattttaatgcttatattaggaaagaataaatgtcttagatcaatgatcagggcttccacctcagaaagctagccaaagaaaaacaaactacaaagaaggaattaataaagataacaaaaattgatgtaagtgaaaagaaatta

SEQ ID NO: 264772 - DNA, 803 bp, Homo sapiens
atgaaatattatgacattattaaatccctattttgtctgtctttggaattcattctggtttacaattcgttataaattgataccagataaagactcataatatagtctgcttaatgactaatcctgtaaaccactgcagtgggatgtgtgaacaagagtaattatgttgttcaacaagaagtacctaattcttatccacagtgtagatataaccttcaataatggaaggtcacagctaatgagacaataaaactggcactttctgtttagttgcaaaagcctgtttgcttgttgacgttgtttgagtattgtctgtatttatctttctcagaacatggcccctgcctctgtgtagttgggacagagtttgcgtacatatatatctgtgtttttgtaaagttttacatatctgaaaaggggattgaataaaatgttattgtcttgaatgtattgaacctcccattctgcactactctgcccttagaacactagaagccagccttataccaccaaagcaggagattgggttgttcctttctgtcaaaagtgatcagacaaaaggaagcaaagggaatccaaacaaaatagccaggttattgcccagtcattctagatcaagtaccctggtctgctcactcacatagattttcccatcatctttttagtatcttactcttaactatgtatgcacagcccaggattgtctctcatttaaggaaagcttcaggcatgaaaggcagataccagtgtagggagaagaagaaaacaacatcaacacccaatttatattctcaaaaaagaaa

SEQ ID NO: 264773 - DNA, 490 bp, Homo sapiens
gttggcattgtaagtgtaagattttaagcagcggggagaaaatttcattcctagcttaaaagctcaaatgttacacgagacactgagctttggttctcagaagtttatcttagtgtaaacttctactgccactaggacacaaaaggaacatctctgcagtcaacaaataagcattttgagtatctactgagcactttttgaactattagcatctgtttcccactttggtctagtgaagattcccatgattaatattttctgcttagttcccagtcgctttctgcccagctgatcttccccgccccatatagcagcactctcacttcactgtcttatctactttagagcctcaccttggagcccttgcttcaagaagtggccttcaagcttcagctacccaaggtccccttgccctgtttatcctttctttttctggcccgagtggaccctggggcagggtgaccttattaaagactctataaaacaaagt

SEQ ID NO: 264774 - DNA, 223 bp, Homo sapiens
tccatctctaagtccctctccctccttgtgcctcctgtgtccctgagtgtccctctccctccttgtccctcctgggtccctctctgagtgtccctcttcctccctgtctctgatctctttggatctctactggcctctcacactgcagccaatgtctctggtctatccactctgtccccaccctgctccctaggtgcccactcagccctggctggcagctttg

SEQ ID NO: 264775 - DNA, 376 bp, Homo sapiens
tgtttttggcatcttcacaaaggagttaaagagatcagactcgttcccaagagagaaaaatcatctttgcaatgtccaaaaagattccctgggcacagctccctctgctgtgacctgccaagaaattttggggctgcttaggacatggggtcattctctagctccagtatactcaccagtggtcagtcaccacctatgcatcgtgagtcactccacaaaccttaaatgaacatcatgttggggaaggccatgcttcgtctcagccctgccctccctgggcttaccatccaaacttggccctgtgtaaattctacaggattcacccctggttttcctgtccactgactcaaatgaccaacatctcaacaccttcctg

SEQ ID NO: 264776 - DNA, 521 bp, Homo sapiens
ttggagacagactctcgctctgttgtccagactggagtgcagtgtcatgatttctgcagccttgacctcccaggttcaagcgattctcctgcctgagcctccccagtagctgagactacaggtgtctgccactgtgcctggctaatttttgtatttttagtagagacaggtttcgccatgttggccaggctggtcttgaactcctaacctcaggcgatctgcccgcctcggcctcccaaagtgctgagattacaggcatgaaccactgcgcccagcctgagttcaaatcttcactccaccacctacagcttgtgagcactggactctgggcaagtgacttcagctctcgggtgccccagctacaatacagagacatcatgccacctatctcagaaggtgccatgaagatacaatgcacagaatcatgtcatcatgtaaatcactgaatcctggtgcaatgtttaggacataaagaaaacaagtatgagtgcaaaaataaataaataaggataaatgaatac

SEQ ID NO: 264777 - DNA, 460 bp, Homo sapiens
ggtcattcttggctagaaggaagcccctgctgaagcagccatcagagcgcctcagcagttaagcttccctgcctccaccctcttactctatgaccctcccctgcctctgtccatggccaccaacgcctttccttttgtggatggcagaccaaaggagacaattattctgcctcaacccaacgctgtgtttccttgtggttctgcactgaggctgggcccagaagcctggttcatgaagagcactcacctggcccctggcccctggcccccgttaaacaggtgagtcactgaccatttccttagagccacctgggactggctgcatgggacttgccatgacacagccggccagactgccacaggcaggttctgggaactgtacacttacatggatgggcaggggctgcctgggattgggagccactagtggtctatgtccccaagagcttgtatatgaccc

SEQ ID NO: 264778 - DNA, 276 bp, Homo sapiens
gggctctgagaggccggcaagtggggcacctgtccccttccttggagcccacttgaggtacccccggggtcagagaagaaagccaggtgtgtggcatctgtactgcttgtcagaacctaggagggccgggcacggtggctcacgcctgtaatcccaggactttgggaggccaaggcgggtggatcacttgaggttaggagtttgagaccagcctggccaacatggagaaaccccgtctctactaaaaatacaaaaaatcagccgggtgtggtggtg

SEQ ID NO: 264779 - DNA, 293 bp, Homo sapiens
cacactgcttctcttctaggacagagttattttatatgtggatataagtaacagtgaactaagatagggtagcatcacttacataatttctcaaggcagatttctgaattgtctctataaattctaacctcaaaatgtcaaattcaaatggatgtcaaaagagtagacccaacaggtgggaaacatgtctagctgtttctttcctggacaagtaaagcacccttgactgttttcttgctctcttgacatgctgctgattgcacagctagagtcttcataccacactctcctag

SEQ ID NO: 264780 - DNA, 641 bp, Homo sapiens
cgacggagctgaggccagaatgtgagagagatctgcattttggggattagggcctagtcaggcaggtaggagatgatgttcaaaaagggaaaagaagcgtgatgaaagactggtttctacagagatagattagaaagctgaagcctgaaaaaacagtgaaggagacccatgcaaatttctaggccctggaggtccaaataaggttttctaagtccctcaggccatgacaggttcagtccagacttgtctcccagagtgtttctctgccatccctactctaactgggacttattggtggtgtttctctcctaaggccagatgctttgcacagaacattaggaaactccagatgtaaaggtaaggcacaactgagaatcacctgcccagggcagcaacacagtgtgaaggaaaacaggccactcaacccaaacttacacctgagacagaggcaacagaaaaatcagaaaaggactttagaacacatataatcaaaatctcagacctaaagacgacttttgaaataaaccataacatatgaagaggcacttatgaaacaagaacaggtagtttataaaaaagaaccagtcagagaccctggaaatttttaaaaaagcaattactaaaataaaaaatgaaaactc

SEQ ID NO: 264781 - DNA, 439 bp, Homo sapiens
agaattataaaatgattctagaagaattccattttaatcctggacatacatttcttaggcccgtgctttaagtgctctgcacagaataatacacccacacttagtcacaatgttattaaatttctgagagggaaaagaacagcgaacacaagtcagagattgctctccagagaagacttgttaaacacaaataattctgctcactgaaagagcccctgttgctattcttcccttctcaaaacactggggtgttttcaatggagagtaatcaaggcaagaatgtaaaacaggtgtcaggttcatatgtttcctttgcaaacagtgatggctttgctaccagggagatcagatgctcacctgtcaactggggtaaaccacacctgtcactatgtcactatcactgtcaaccactatgagcatctgtcagaatcaaaaacca

SEQ ID NO: 264782 - DNA, 422 bp, Homo sapiens
agttgagttcactaataaaattatatttggaatcttatatcattcccagattaatatatacaatgtatatcaaatgtcattgctatggaaacttaagtttttacacatgaggttaaatttttataaagaaattttttctccagaattgactttatgaaacttgacatcctctgtttctggcatgtattaagaaaatgtcaacccaatgtcaaaggataattaatttttttaaaggagaggacaataatggttctcatacaaatgtaaaatgaatatatgttcatgattttatttaactgattaataaataagagtgccataggatgttttgactggttcaaaggagaatacaaagagcagagaatatataggcagacattcatgctgaaatgaatttgcttaataaaggcaaaattagccaa

SEQ ID NO: 264783 - DNA, 785 bp, Homo sapiens
aaagagggcatgatagatgatagtttaaagagggcggcacaacggaagctagcatttggcaggtagcccttgtattccatgcaaatatcagcttcctgcatttgactgtggattgtaggaagagagtattcctgtgccttctagtcaatatggatattaagagcacccttgtcccacctttttaaatactgattcatcccctaagggttttcagatagtctttgatcaatgggattaaattattttgtaacaaagcattttgcaaaacttactattttgagcattttgatgctcaaaatagtaagttggttcttggaacttttctcctacctagcacaccaggatatttgtatttgaagtggcagtgcttcttatgaggggttagaggctgttatgtcagaatctatgaggagccaagtgtggtggctgctcatgcctgtagtcccagctactactcgggaggctgaggtgggaatatcacttaggcccaggagtcaagcctgggaaatatagtatgaccctgtctttaaaaaaaaaacttgggaggaaatacacagtagttagaaaaagcctcctaggtgattttgatgaatcccagtctcaaatttcttcatttggaaatgataatgtaggccacacgtattactggagaaaaatgtgctcccgagactttccagagcagcagagctgggactaggcaggtgaggcagctacgtgcaagtgtagccctgagaatgagcacctctttaaagaatgtaccttgcgttagttctgtgcctgtttaa

SEQ ID NO: 264784 - DNA, 500 bp, Homo sapiens
ctgggcaataagagcaaaactccatctcaaaaaaaaaaaaaaaaagttttgtcctcttccttcttgaggagttgctttgaagcttcacagcaaccaaggaatctatttcactgatgaaacaattcaatctactttaacatatggctggttatttagaatgtccattttgcatactactctcagtcttccagactgctggaatgtacaaataaggtaatagaaaatcaatttacaaagcttacagaaacttttaaccttccgtggcctaaggcttttccaatggtcctgaatgaaggaacctacaaaccagctctccttaatgtgagctcctgggagacaaaaatatcaaagatcaagggctccaacctggagattttgtttatgagaaatgccatctaataaaggactccctacaaccatgttgaagagaactccagcctgggcaacagaacaaagaccctgttaaaaaaaaaaaaccaacttaaatgagtcccaagaaa

SEQ ID NO: 264785 - DNA, 350 bp, Homo sapiens
cattcttaaagtgttcggagatcccagatgaaaacctaaaggaccctcatgcacacaagagctctgttaccagttgtttgtacaacctaggaaagctgtatcatgagcagggacactatgaggtctggccaatgcctctctgtccttttccctcccccttgttctgatccagtctcagtggtttgtaacctacagcctcctttgagcctatgtcctttgaacaactaatatgtatacacgttaaactattgtcctttgagaaactaatacatgatgacattggaatggttttttgatcaaatttgtttagaaaaagcttctgctaaataaaaatttaatagatttaaaaa

SEQ ID NO: 264786 - DNA, 489 bp, Homo sapiens
ggacaccacccaccgtatgatagggtatagaagaggcagggtaacctgtgtagaaaatcagctcccagcctcctgctcggaccttaccctcaaggaatgcagaaccccctgtgtatccctttctcctcctgatatagtttagatatttatccccaccaaatcttcatgttgaattgtaatcccagtgttggagatggggcctggtgggaggagttttggtcatgggggtggacccctcatggcttggtgctgtcctcactgtagtaagttctcacaagatctaattgtttaggtgtgtgccacctaccccctcccactctctctctcttttgctcctgcttttgctatatgaggtacctgatcctgcttcaccgtccaccatgactgtaagcttcttgaggcctccccagaagccaagcagatgccagcaccatgcttgtacagcctgcagaaccatgaaccaattaaagctcttttctttataaatta

SEQ ID NO: 264787 - DNA, 262 bp, Homo sapiens
cagcgtccttgtcccttccaccctttgtactggtcctacctcctgaaacacattcaagtttattcccactttgccctgggtacaaatatttgaacactgctttctgctcccaccatgctgcactccaggataaagagacccagctcgggcctttctctgtgcaggacgttttccttggacacgtacattctgttgccctccgcttacaaccagcaggcatttccactagggaagaggaaggggcgtcggtccagctgaaagt

SEQ ID NO: 264788 - DNA, 770 bp, Homo sapiens
tgcgagctgcccacagctcacgccaagccggcttccgctctgtccatcaattcaggcccactgagcacaggttctcggggaatgctcaagagccccatgccaggtgggtcccattcacagatgtctgctcaccaaccagcaggaagctggaaagtacccccaggacagctagcagcccacagtgagctgtgaggcacacagcaatttggggctaattttctcctgcaaagaagttgatcccataatctggcaaatacactaatcgtcactgcactgctcagagcaggagcttagagctacagagtccggggggaacaggctcggcatagaatgagaccacggactgccggcttgaagaatgtgctgccaggatatgaaacccaaagctggcaatggaccacaagctactcccagtgacagaggacccaggccacagaccagctgctgtgctgggcacaatgcttctattgtcacggaaccctgcatccacgcccggccccgcttgcagatgggaaagctgagggtctggggctgcaggatgtgctcggcgccctgctgatgaccttccctgggccagcctgacccccggctcctctgatcctctctgctttaacggaagcaaagaatgagttgtaacagccgaggaccaaggagcagctcttctgtcaacagatgcaccggaaaatccgcggtggccgaggaagccctattttctttagtctgctcagcatttcttgtacaataataaaaacatctgaatttccaacaaa

SEQ ID NO: 264789 - DNA, 522 bp, Homo sapiens
cattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgctttgcttgggcataaa

SEQ ID NO: 264790 - DNA, 1050 bp, Homo sapiens
cgcgagtccatctctgctcagtggctcctggcagggacacctcctcctatcaacccttctcacaggcgggagaaggaagccccgggtcccacgagctggagaaatgaggccaccctgcaggctgtgataagcggggagttggacccgcataggccgacagcccagctcaacaggtggtggtgggcttatcccttcctgcattatccggataataatctgccagccccattcaagtccgtcgtggaaaagtctgccctcagctttggcatgggtaaactgcctagaagcgactgcaaagagggggcgtcatcatctcccccgatacatccttgggacagacagatggacagacagacacacgcacacgcgcatacacacgcccgcgctccccaccacactgccccttccagggtgcgcgatcgctagggctctccagcccctgcccctggctgggctgtcatgggggcgcagcccggcgccgcggcccagcaccggtgggagaccgtcccccagggacccccccaggatggaagaggtggtctctcccggtcttcccggctcttacctcgctggagcggccgcgacccccgaccctggtccaatgtccctcgccggctgggcgcgcggggcgggaggtaccgcgctaggctgcccgggacgcccgccccgtccagtcagccggaaccgctcggcgccaatgaccgtggccgccgccgccgcagctcgcgccccggaccccgagagggaggggcgggcagggggcggggccgagggcggggcctccccaccccggcgctgccagctgcaggcggggtttgggaccggtcagatgcggtctcccagcccgggaggtgagcacctctggggtgagcacccttgtgggggtggcaggtgaagagttgggggccggcgtgggagaggagaggctttcagagtccgcatagggctgggagaccctgcctggagtcagactcaccttcaaattccagcagctggggctgcagcctctgccgttgctgctgcttttaaataaggatgatgatgatgatg

SEQ ID NO: 264791 - DNA, 471 bp, Homo sapiens
tgtacatcacaggtttactgagggtatcacatgtatacgtaaaaacattttgaaaaccattatgtgctagtcaaacataaaatattgaaagaaaaagaaggtatttccattttgtaatataataatttgttaatttttttttcagtagctactatgtactaagcactaatgatacaacaagaaagactcttaccaggccaggcgcagtggctcacacctgtaatcccagcactttgggaggccgaggcgggtggatcacttgaaaccaggagttcgaggccagcctggtcaacatggtgaaaccccatttctactaaaaataccaaaattagctgggtgtggtggcaggcacctgtaatcccactactatagtggctgaggcaggagaatcccttgaacccaggggcagaggctacagtgagctgagatcgtgccactacactccagcctgggcaacagagactctgtctc

SEQ ID NO: 264792 - DNA, 320 bp, Homo sapiens
gagacgtggttttgtcatgttggccaggctggtctcaaactctggacctcaggtgatccacctgcctaggcctcccaaagtgctcggattacaggcctaagccaccctgcccagtgtaaactgggaattttaaagtaaacagaacttcatgggtaaattcctttggggggaaaacacgttaatttttctgcagccctggcagtagcacttcacatctttcccaattattttaagcacgctccattttctttccttctgtgttcaaattatagttagaaggaattagcagcttctatcaaggtgacttaaaacaacctatt

SEQ ID NO: 264793 - DNA, 697 bp, Homo sapiens
cgttaaagggaaatccctgcttagatataaacttcctaaattaatataaatatccttacacagttaaatatgagtttaggaagcaagtgtttaggtagcaagggataattcatttccattatatgccattagctcttggaaggtaggcttccaattatgaaaaacactgatttcattgaaatgagggttttctactccctaaagagaaagccatgggaataggtagttttattcaagtgaccaagtatggcaagaatcacctctcacctccctctctgcattaaccccacagatgcaaacagacttctctctagttctaaagattacacacttcatcttaatactgttgggaaatgaagaataagaagaaacaaattctagattactacagtagcacatctataagatgagactttacagattaatcctctttgctgcaaaactagatttttttttcctctaaaaactttcatctttctttgattggctttacctgtttttttccctctaacaatggtgaagagacaaattgtactcttctggaaccaaatcttgaaatatttaataaatacctaatttatctaaatcatgtatttacacatatttgttcagaatacgtaatatggcataatttgtcattttttagtcataaacctcctctgactccttcacaaagggctcaggtttccttgccttg

SEQ ID NO: 264794 - DNA, 440 bp, Homo sapiens
agcaaataataagtggtctgtctggagaattacatccatgtctgtgttctggttagggcagcattaacactgactgggagccaggaccaaggcagcatgtaaattcaatttccccgtgtctgatccacaacattagggacttgctggatgctataatatcatctattcattcattcaacaaatatttatcaaaaggctttctctagccaggaaccgttctaggtgcttggaatacaataatgtgcaaaacaaacaaaaatccctaccttaaaggagtttacaaactttactttcaactaggcaagacattcggaatagtaagtagtcttacccaccctaactaatcacaaggacttgggagtggcagacaacaagagttgtttcattgtaagacattctaagagcttttgaataaaaacttgaactggaaaaaaaaaaaa

SEQ ID NO: 264795 - DNA, 463 bp, Homo sapiens
aacttgaatataaatattatatgaatatcacatattttcactaaaaagaaagaatatattgttcttattattgtattttaatattagagtgtcttgggctttgaaactcatttactttaggttcctgaatacagaaattctttgtacaaatccctgatgagtgatcaggtagcctgaggtccatctcttagtggaagcaggaattgtcttgaaaatacacatttcagagtcacatgatttgggtttgcatactggctccctaacttacagatgatgcgacttcaagcaaacagcctatttcctcatttttttcatttataaaataggaacaacaatactaacctcacaaggctgttgtacacataaaaagaaatacaaatgcacatgaaagcctgaaatatggtatgaaaatgtatttttaaaagttagtgagcttaatgaggaaagggattgtgtccaatcc

SEQ ID NO: 264796 - DNA, 408 bp, Homo sapiens
caaatggagaggtggtaactctcacccactcactggtgatgtatctgtctgtctggaagacattcaaaaaggctttgcatcttgataggaaaaacatcctggattctctctaactcttcacttctacttttagacctacaatcggatgctttccagaagttgccaagaagtccctggagaactagctgactcatgcccatgtgctatctcaggctaccagagagcacctctttccatctggagcagctgaaaggttagaaatccggtgttcaggcatcatcactgggccccatgtactgtactggcttctgttcccacaggattaatgctgcttcctcaagcaatgactctgaacagcggctaccctatgttgttgcacccagaaagggaatggtggtgggtggctgg

SEQ ID NO: 264797 - DNA, 482 bp, Homo sapiens
cacgaggttttcccatgtcttgtattttctgcagtcattatggccactgtttacaggtcaccttcaaaggtgcctgcaacttcatatttggtctccacgaccaccttggtagtgggtcctattattaggccatttcacagatgagacagttcaggccccagtggtgtggggggctgtgttgggaaccctgctctctgatcagtcattgtttggcctcccgtgagactcctgagtgataaacttgcaggttcagcactttccacagagtctagcaaaacctcagggaagagactttcactttccataaggaatttagaacacacatagctttagtgatcttgttactggctgagctggcatcactactagcaactcagctcatgtctcctgggggccctcgctgtgcctgggcccgccttggcccaggggaccattcatgttcaagtgcggctgccactttatgttttcacggcagcttctct

SEQ ID NO: 264798 - DNA, 350 bp, Homo sapiens
tgttcaaacctttatctcaaatatgatggaacttggagttggagatgggcctttgggaggtaattaagtcatgaggatagagccctgatgataaaattagtgcccttataagaagggacatgaaaaagctttccgtgcttgctctcctctttctctcacctgtcccatctctctctcttctctctctttctctccctctgtctctctccctgcaatgtgaagacagcgagaaggcatccatctccaaaccaaggagagggccctcaccggacatcagatctactggtaccttaatcttggactttccagcctccagagctgtgagaaataaatgtttgttttttaaacca

SEQ ID NO: 264799 - DNA, 510 bp, Homo sapiens
aggcttcggagacttgtcagcagtctgtagcttatttctgtgtgtgtgagggtgtgtgtgtgtgtctctctctctctttctctctctctcaccatttccaggctcaaatcactgtggaggaacaagcaacaaagtcttgtcaggaccttatctcagggtaacgattagttaaaaatgaaaggctaaaatattgattttctttagaagaataattgactgtttgatatagagaacacccagtttcttcctgaggaaagctgaacagggctacattagcagcccgcgtctctctgacagcagcaggggctgggtttaagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaggaaaggaaaa

SEQ ID NO: 264800 - DNA, 634 bp, Homo sapiens
aaacatctctccagtaaaagtatcaataaattttattggactatttctgattacgcccctcaatgtaggttaacagcataatgccaaaagcattggtcagtaaaaccaattacacaagaggacaaaacactgctcatatacgcagctttctcataatcttgtttaggaagacaaaatgacaatattgaataccacttcacgtgcccattaacattgctactatcaaaaaaacaatagcaacaagtgttggcatggatgtggagaaaatggaacccttgtgcactactagtgagaatgtaaaatggtagagctgctgtgcaaaacagtatggcacttcctaaaataattaaaaacagaattgctgtatattcagtaaatccacttctgggtgtatacccaaaataacagaaagcaaagtctcaaacagatacgtgtacatctacgttcacaatagcattattcctaatagctaaaagattgaagcaacccaagtgtccaccaatggatgaacaggtaaacacaatgtagcatatatttacaatggggtattatttagccttaaaaaggaaagaaattccaacacatgccgcaacataaatgaaccttgaagacattaggctaagtaaaataagcc

SEQ ID NO: 264801 - DNA, 491 bp, Homo sapiens
ccagctagcactgcactctggtgcggttcttatctccattcagaaaacccatggggctgggcacagtggctaatgcccataatcccagcactttgggagggcgaggcaggaggattgcttgagctctggagtttgagaccagactaggcatcacacttggctaactttttgtatttttagtagagacggggtttcgccatgttgcctgggctggtctcaaactccttagctgaggcagtttgctggcctcggcctttgaaagtgctggtattacaggcgtgagctaccgcacccagcctaagatacttcttaatatggaaagccacaaagacaaataatggtggggaaatctaataatactgttagacacgcctcaccttttaaacatctatcacatgttaggcttaggattgttttatggtaaaaacccaagcattcaattctgacacccaaaggaaatactatatattaaagtatgtattagtttcaat

SEQ ID NO: 264802 - DNA, 393 bp, Homo sapiens
ccagctagcactgcactctggtgcggttcttatctccattcagaaaacccatggggctgggcacagtggctaatgcccataatcccagcactttgggagggcgaggcaggaggattgctcaaactccttagctgaggcagtttgctggcctcggcctttgaaagtgctggtattacaggcgtgagctaccgcacccagcctaagatacttcttaatatggaaagccacaaagacaaataatggtggggaaatctaataatactgttagacacgcctcaccttttaaacatctatcacatgttaggcttaggattgttttatggtaaaaacccaagcattcaattctgacacccaaaggaaatactatatattaaagtatgtattagtttcaat

SEQ ID NO: 264803 - DNA, 704 bp, Homo sapiens
gaattattagaattatagtgaaatagaattattagtgataatataatagattagtaatatattaatataatagaactattagtgatatattaataatgtaattagtgatatgttactgaattattagtgaacagttattagtgacttagtgattattagtgaattattagtaatattttagtgaatattagtgaattgtaatagaattaataataattctattattagtgatataagccatatgcattttacagtcttaaaatgttaatgacccattatatgaaaagcatttatttatctgcattcaagatacatgtttggttaaggtccttgtaattaaaataaaaatcagaatcaccatattataccaacattgatacaagtaataattaacaacaacaatgatgatgatgatgattaaaaacctggataaaattttgtctcaggcttagtgtggtttgggtatgcatgtacttatcatatttgattttgattttattttaaaaattttgtctttactttttttcttagcatcttgacccttttgtgacatctagcaggatgtatttttttttcaagatgcatgtttcacaaacaaaatatatgtttatatctgactgtacccaagctgctaattatgggcatctctttctatagctcactattaatcactcatgtctttggggttatatagaaaacaattt

SEQ ID NO: 264804 - DNA, 462 bp, Homo sapiens
tgtccggacattgctgcccacagtggaagctgcttgtgttacatctggtccagccacagcctcacacagagccagcacctgcgccagtgcctggagctgcccatgccaccacagctggcctacaagggtgtgcacagtggctggatcccacattcactcactcacacaccccttggcactctgtgcctggctcaccctttgcagacatgggatccaagcagttagcacaagctgagcgcagcctgcccaaccaagtggacagaacaagcttagcacatgcaagtgaaacacaagcataggtgccaccagccacagaggtttctgcctggtgaagcaacaccctaaggatcctgtgacaaaagggcaacttgtgaaggtggaagtgatctatttccctgtaacatatttcatctctaaacatgttattaatgctcattaaataattatcaataaatgaagaaa

SEQ ID NO: 264805 - DNA, 410 bp, Homo sapiens
cttctccgcacatatttcctccttgacagatctgggttcagattttgactctgtcccttactaagtgattcggggcatgttgcataatctctctaagcctctttttcctcatttgcaaaaggtatgacactcaaacctatgtccatgtccaggggattcccaggatgtgagactttcagtgctaaactctgggctggttaccttagggtataaggaggataatgttgagaaagcatttatcgcaacacccagcacactgcaattgctttataagtaattgttattatcctttcctcttgcctcagatatttttgtttttgtttgtttgcgttgcccaggctgaagtccagtgagctgagatcacgccgcttcactccagcctgggctaaagagcgagactctgtatcaaa

SEQ ID NO: 264806 - DNA, 395 bp, Homo sapiens
tccccaaagatatatcctaatccatggaaactgtaaatattattttatttggaaaggagtctttacagatgtgattaagttagggatcttgaggtgagactatcctgtattctccaggtggaccctaaatgcaagcacttgaatccttataagatgaaggcaaaggaagatcacacatacagacagagagatgatgtgaatatggagatagagattaagggccacaagccaaggaatatgggcagctatcagaaatgggaagagtcaagcaacagattctctccttgacatttaagaggacatgcagccctgttaacacctttattttagcccagtgaaactgacttatgacctccagaattatgagaaaataaaattactatttttaagctaaa

SEQ ID NO: 264807 - DNA, 482 bp, Homo sapiens
tattattctaggccctaagtgcttgataaagctttatcatcagcagaattgaggaggtgatacctctaaaaccatacctacgaaatattagctgtagcccttgtgcagtttcagttaatgttagcccttcctttttcctcaccatgattgaaagcagaaagttaagggcagaatttcacatatacagaatgccagctaatcagcatatcatttcacagaattacattttattcagatagctggtgccattcagtgctcaatttgtataatcttacaacatgcagttataaaaagggaaggccatttaagaatctgtctgaagcagtcaaaagacaaggacatattgggaaagagtattttcagcacttgaaatagacaaggtgttaacatccaaaatgtattttggactcttacaaataaatgggaaaatccagttgaaatataggcaatctatatgaatggtcaagtcacagaaaaaaaaa

SEQ ID NO: 264808 - DNA, 658 bp, Homo sapiens
gcagacttccagtttccacaattctcaggggttaagagtagatgagctaataattgaaggattattttataattttagagagaattaattgcaaagtagtttactcttcttaaagcactaagaattatatgatacaaatattagcttttaatttatttaagcgattaaatatatttccctgtgaattaatatgatattaaatctaatctaagatgtttataattatatgcagtgctttatccctaccttcatcatgaaggacgaattaacaagaagctaactttgttttcactaacttgaaatttcaggatgggcataaaaaatgaaatatatttgaactgaactaagtaattatgactaactgatgttatttgtcattatatgtgtgattgaccaataactactatcattgtgtttaagtacgagagccaattacagaatataattctaaaaagtaaaagaaaaaaatgatattgcgcatatttgattgggtaaagaaagctacatgtggaggcttaagttcattgggttggtgaacagtattaatagtgaccactttatgatatttttaaaaatgttttccaaaagttttaacacaatttattttccacagtaaaaaaataatgttaataatggctgtcttatatgctttgggcta

SEQ ID NO: 264809 - DNA, 526 bp, Homo sapiens
aggtaattaggttatgaggttggagcactcatgaatgggattagcatccttataagagataccaaggggggcttttgccctcttttagccatgtaaggatgtaatgagaaacaagagtctgaaacaaagaagaggaccgtcacctgaacccagcctcgtcagcatcttgatctctgacttccagcctctagagctgtgagaaataaatttttgttgcttaaaagccacccaatgtatgacacttggttgccaaagtctaaactaagatactgagtaactacgttttgtgtaagatgagcgtatcagttttccacagaaaatacatgctttattgaagttgcctctttccaacctctaagtctctgatgtctgttttcatgatggctaaaaattttctgaacttgtttccttatatatcttgtctaatgcagccaacagtttactacctttgctcttaaattcccttttccaacctttgcattcagtaggtcatttgttttggtaaataaaatcttaatagtatgca

SEQ ID NO: 264810 - DNA, 379 bp, Homo sapiens
tcagctacaccgctgtagaatcaccaaacaatgcctccaaatccctcaagaagtcagccatacagccttctaactttaggagcatctcatgttgactttgtcaaatatctcaggatccatcacgaaccacagatgaactagggccccgagcttcaacatcagagagggagatgtttccctgcatttggttctcaaacacacacctctacagacgtggctgaatcccctcttccatccctctagggaagagatggcctgatacggagtctggctagagtactgaaaatttatcataatgtttatacttcatcgtcttctattcttgtgccttctagccttaaaatgtaaccatgatatatacagaagttatccctcaaaa

SEQ ID NO: 264811 - DNA, 720 bp, Homo sapiens
gggttcaatttattcacttgtaagtgatctcaggaagacagtagtcaggagcagagagaataagacaggaaaaggaaggtagtcagtataggacataagaatgaacaggttatcactccaggcaactagagttaaacctctgagaatgagactgaaacacatatctcccagtttttccactgaggggtgaggaggctgggatgcatgttcatctgtttcctactattcccattctcgttagttgggagttcacttccagctttcctatctagatctatagcggtggagcaggcttctgcaactagagagcaccttcaaatagagacacacacaaagctgcctatgtggacaggaactgcctgaaggggccctctggggtgaaccaacagaatatgggcaggaccctgtcacagggtggattctcctggaagcagactctgatattaagagtaatggacagggtattaactaatgagtgccctggcgatcaacactatggatgtgaggagaagggagcagtattgagcagagggtaaagtcaagcttctaagatgcaccagcatgtaacttaggatgagaataaagtctactcagaagagtgaaaaatctaccgtaggatagtcttagaggaatatggccaaggagaggattttctctcctttcattaatgaaaagttataatctatgtgcagcttgccacattatcaagtgagctcagat

SEQ ID NO: 264812 - DNA, 416 bp, Homo sapiens
gggtccgctgggttcgttctgcccactcagcctggcaggctgcactcagcccacgctaccggcctggatcccatgcctccaagggagactgcaagtcagagttggccatgcccagttaaataccagcatacaaggaaacctcacctcgttgggagaatatttcacacccctccaaactatcagcacagtggaaacttggcatgtcccacattaaatctggctgcagctgtctcagggatccaagactgaatgactggtgattttacattgatgttctgctgaaccttcctggtacctgagtggttaaaatctgagaatttctagaagaaaagaaagtacgtctaaagcaatgctagaaaggagctaataaattcttcaggattaacatcaaagtctgatggatgaggcaggcacac

SEQ ID NO: 264813 - DNA, 426 bp, Homo sapiens
aaggttccccaatacctgaacaaattggggttctctgaggaaggaagaagaggagaagcctttagggttcgtttggggcaatcctatctcctccaagcctcaagtagtatatggctgtttttccaaaattaaggccaggagcagtggctcatgcctgtaatcccagcactttgagaaactgaggtgagtggatcacttgaggtcaggagttcaagaccagcctggccaccatggtgaaaccccatctctattagaaatacattagtcgggcttggtggcacatgcctgtaatcctagctacttgggaggctgaggtaggagaatcacttgaacccaggaggtggaggttgcagtgagccgccaagatcgtgccactgcactccagcctgggcaacagagtgagactctgacccaatactcggcgct

SEQ ID NO: 264814 - DNA, 502 bp, Homo sapiens
agcccacagaggtaattccactctgcgcctcaattattcatcgcgctggggctgtctctgcgtggtcacctgcgcgctgcagagtcccccagcgctccggggactgctcgggggctgctggggggcctctgggaggcctgtcgctcgaggggaggccggatcaaggagagtcacgcggctccctggggagaacgggcgccgggccctcacagaccccagagcggccatgagctggtgtgcagccgcccaggaggggaccccactttgccaggaggaagcagctggttgaatagcatttaaaaagagatttgaagattgaggagcagatgttctgagttctggtctggtcctgggagccatgcagccttggtcaagtcagttccatcttcctgaggctacacttcagcatctgtaggatgggagtgttgagcgctagatctatgactggtgggccaaacctgccctgctgcctgtttttgcaaataaagttttattggaacac

SEQ ID NO: 264815 - DNA, 384 bp, Homo sapiens
ctccccagctaattgagcttctttgctgaacaccagtgagatgtgagagatgagtttggattggaattccattatgggttttcaataattaaacattacatgtttggaacctcattcttctgtattactttttaaatattaatctatttacatcagctggacttcctgcagcttgatacgcagtaaacgggagtcacactgagaaagacaactgtgttcttagcttaagacatctttgatgatcaccaacagtaaaggcgacacaaaccctctgttcaacccaaccctgtataataattaccctgccttttagagggtggctggttccacttttttcagcacactcacacattcctcatgactacactgactttccaaattagc

SEQ ID NO: 264816 - DNA, 302 bp, Homo sapiens
aaagctcacggacccgctggtgagggctgcccggactgctgattccactcagccactcaccacccgccctgtctgccaggtgccatgtgcaaggatgctgcattttctgctaatgggggtgggggatggcaggagacataatggggtggggaggggtcattgctattgtcgtcatcactctttgtcaccccaatggcattctataccttcttttgcatctgatctcaaggcatcaagaatatgaaaaacagctcttctgtccccaaaagggagatcttaccttaagcaatgggattaccatt

SEQ ID NO: 264817 - DNA, 391 bp, Homo sapiens
cgtgagccaccgcgcccggccttagagcaagtttttaaataaatgaactttatattgcttttcttttattaccaatctttacgttttcctttattaattaactctgaatattgtcttgaatgtaacactgttcatgaacttttatcttcaatttaagcttatttgagagttggataccatgggatatgaatcaatcaatacagaagcaaagctacattttaaccctagaaatgtaatttatgcagtcttggctgtctatgcaagccataagaaggtctcaattcacattttcagcctttatgatttgggatagaaagaagttgtttttaagcaatatgattaagccctgttactctttgtcttagccatgctgacaggtagcaacatggag

SEQ ID NO: 264818 - DNA, 436 bp, Homo sapiens
ctgggattacagataatttttttaaagttaagattagcatgcaaaaagctggaaagagcttcattttcatacttataattttttgaagccagattatcaaaatcataacttgaatttatcaaagaactgaaatatcaaggcaaccagttaacccaaaatataaagaaagacagactcctcaaaggacagatggaatgcaaacccttgtttacttgggacagatgccagatattatacaagccagtaagaataagaattcagctaaaattttagacaaattagtaaaggctagcatgagtatatagaagccctgggagtcacaaaaacagggaaattcgcatcagtctctaagcctttttctatgaacctcaccagggtcttctgaaacattagggtcagagatgtagaccagataaatcctctctcatgatgcggg

SEQ ID NO: 264819 - DNA, 757 bp, Homo sapiens
agaaggcaaaagaggagcaaagtcacgtcttacatggtggtaggcagaagaatatgtgcagggggaactgccctttatagaaccatcttctgagactcattcacttatcacaagaacagcatgggaaaaacccacccccataattcagttagctcccaccagttcccttccaccacatgtgaggattattacaattcaaggtgagatctgggtggagacacagagccaaaccatatcaattgataattagcagattaaagggaaaaaggcaaatctgttgactaagacagccttcacgtttccctcagcttgactgttacacagttttcctcccgacctccttgtctattttttagttttaatttttttgatacataattgatgcacatatgttgggggtacatgtgattactaaatacactcacaatttgtaaagatcacatcattgtgatcaagatattcatcaccctacatatttgccttttcgttaagctagaaacatttaaattcttatctttagctattttgaaatgtacaatagattactgtaaactacagtcaccctgctgatttattgaacagtaggtcttatttcttttatcaaactctgtatttgcaaggcgggaggattgcttgagcccaggagtttgagaccagcctgggcaatctactgagaccctgtctctacaaaaaatacaaaaatcggcctggcatggtggcacgcacctgtagtcccagctactggggaggctgaggt

SEQ ID NO: 264820 - DNA, 431 bp, Homo sapiens
tcttcttggtgtttttgttccttgtctttaagacctggtctcaaattcagaagttcaataccagcgtcagtttgacttgacacaatctatggttgtagtgtattgatttcacaaattgaacctatggtgagtttgaattatgaattgagagagaaacaactgtggtgaaaactgaagtcatgaggtttatctattcagaacattcaataactaattcaaacacaaagtttttttatatgtttaaggcagataaggtattgaatctgatagctttatgggtgggtaagaagagataataataaaactagctcccaaatagaataacaatttaaaagtaaaataagcatgtgttcatattaaatcactctcgctttcactatcaaaaacaaaactatccatgtaaacagaataaacagatgtaattctactaa

SEQ ID NO: 264821 - DNA, 174 bp, Homo sapiens
atctaagataaggtgtcatttctttaaaataacttgctatatctacaaggtgttttttgtaagccttatggtaaccacaacacaaaaacctgtaatagagtctctgaaaatataaagcaaccaattaaaacatattaccagagaaaattacataaccacaaggtagacagtaag

SEQ ID NO: 264822 - DNA, 399 bp, Homo sapiens
aggggcagggatggcatgagcctctgatctcgcttctacaggacagagattttcttgtagtctagttcaaatctgtgattaaagtttttcccccacatgtaataagattgtacaaaatcatgtttgtttttttcatgaatagaatgaggaaatttctaaagaattgtttaaatgcataaaaatgaagtcttatgtttgtgaatgaacttaaagtttacagcattatgatatctgtgtatatataacagtgtaaatggtattttattttacattcagtcactaataatttttcctgttttaaaaatatgtattttttatttttatttatatttatttatttatttttgagacagagtctcactccagtctgggcgacagagtgagaccctgtctcaaaac

SEQ ID NO: 264823 - DNA, 510 bp, Homo sapiens
ggcaacagagccagactccatctcaaaaaaaaaaaaaaaaaaaaaagcagatgcaaattcccagcacacatactgtaggtctagaatgcagcctggacattcgtgttaagcaagctttccaggtggctctagtacaggaggtccatagaccacattcctaagaaatactgttctgggcatcataacatactggggcaagtccaatacagatttcaaaatcctgtccttcaggagccctttgggctagcaggagagacagacagctaaccagatgtagatactctcaggggtgcctggaacatggagaaaacaggaactaactccgccccagggcaggtcaggagagaagcagagaaatggtgtgtgcactgagcctgggggcccgaggtagacctaaccacgcgtcacggtgggatggtcttgagcatgtaagatgtctcgaacatacagatgcctgtgttgggggcaggcatgtaataggtagcactaggttattttagttgggttttg

SEQ ID NO: 264824 - DNA, 644 bp, Homo sapiens
atttggaagaagaaagacctattaggaagattttgcagtggtgaaaggagatagattacaaaaaccttacaaaatatgagcaaaactgcctgcaaaattaactagtaagagatgatacatgaaggaagaattcaaaggtgattctgacattaaaaatctaaacagttgggacaatagctgtatcatttgcaaacacaatgaaaatgagcaggttgtaaagaaagatcaccattatggttttgaacacattgagtttgaattttgtatgatagaaaggacagccaactggaaatgtcaacttgagatagtttgaactataaatatttgggaatcatctgcatggaagtaatagttggaatcctgggaatgaatcagctcaaagtgtggtggaaaactatttagagcaatgcctagaggaatatgtggctgtatccgtggaagaagggcagacagcaaaagagaaggaaactatagttagagggatagagcagaaaaaatagaactgacatttcttattaaaatttaagaaaatttgcaagttatttgactaggttttctgaaagaaagctattaccattgttaggaagaataactaggtagctttattaccgttcacatgtaatctgctatgttaaacagaaata

SEQ ID NO: 264825 - DNA, 346 bp, Homo sapiens
taaagtgccccctctgcacatgcaacattgagtaaaccttgaaaatatgatgctaagtgaaagaagccagtcacgaaagaccacgttttgtaattccatttaaataaaatgtccaaaatagaccaatacatagaaacaaagtacattggtggtggcccagggttaggggagttggggggaaatggagggatatgcggttttcttcggggtaatgaaaatgatctaaaatttattgtggtgctgtttgcacaactgtgcaaatatactgaaaaccgttgaattttacagtttcaatgggtggcttctgtggtatgttattaatatttctcaataaaacttcaaaaaa

SEQ ID NO: 264826 - DNA, 440 bp, Homo sapiens
agatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccacccctagccaaaaatacac

SEQ ID NO: 264827 - DNA, 623 bp, Homo sapiens
tagaaagtccatcccattaatccagagttaattaatatccagagctggtttacaggatattgacatgttctggcatacattaggaatttacacagaatagtaatgactattcaaaaatggggtagttatttaggcagacgactttatcaactaattgtgaaggtagcatattatactatgaagatgaatctctacaatgcagtggctatcaggattgcattaatcatgcaagtatgggcctgattcttatggagaacatttccaaagtgaaaatcctcagaaatagatccgtgacaaggaacaagacaaggatgcccattctcaccacttctattcaatatagtattggaggtccttgctagagcaattgggtaagacaaataaatggcatccaaattggaaaagaagaagtaacattgtctctgcagatgacatgatcgtatattaaaagaaaccccaaagactccaccaaaaagctgttagagctaataaatttagttaaattatggaatacaaaatcatcataccaaagtagtaacatttctatacactaacaacaaactatcccccaaagaaatcaaaacaataatcccatttataatagcatcagcaaaaataatata

SEQ ID NO: 264828 - DNA, 452 bp, Homo sapiens
agaagaaaaaggtaactttaataaccctctgccaactgccagagggaaatgctgaccatctggctcaatatctggccctggagatgctgctagttgacccttgacacccaagtagaagcaggtagttcctcagccacctccatccctgccctcccaagatccaggtgcagattagctgagcttctggcactgctggaatatagagtgtggttcaaccccagcccagagggttcttacaagactggtcctttctagagaggataagaacacaggccgctaagaaaggtatgtaagctcgggagggaggaaagaaaggggaagggggctagaggagattcggacatgagatgcattcaccctatgagttaaaccccagtctccagcatgggagttgacaattccattactgaaccatcagtgttccatgtagtataacctctcatgggtttaaa

SEQ ID NO: 264829 - DNA, 683 bp, Homo sapiens
cccttatcgtgagtttacatctcttggtacaggttaaataagccttagaaactattttaaatttaccactggtctgctgctgtatcacttgccaaatcatgacctaccaccagtgcttctccagccccagaaagaacataggcagaggcagtgttcaagaaggaatcgaccagctaacacagctcctctggttccaaccaataccccagagccacggtcaactgaacacaggttagtctgcacctctgaaattctagaaatagaacttctggtacttcctgatggtcagggtttctcaaatcactatgtacctcttagccagagctcaaagatgcacctcagaacaggtggggctgagctgcagctgaggatactatcaaaatgttacaggagggtggaaatttttgcggtattctcagcaaaggtaacagtgcctggcacatcagcaggtgctcaagaatttgttgaataagtgaatgactatctgggcactcagataaaaaaaaagataccaatcttactcaaaaatagctattatgaagaatctcatttttcttgccttttattccttattctgcccttcattttcaccctaagagggctagaagcatcaaccctctggccccctgacctcaaagagtcctcaagtgtcagcctgacaaacactcagggacaggagtacc

SEQ ID NO: 264830 - DNA, 727 bp, Homo sapiens
cccttatcgtgagtttacatctcttggtacaggttaaataagccttagaaactattttaaatttaccactggtctgctgctgtatcacttgccaaatcatgacctaccaccagtgcttctccagccccagaaagaacataggcagaggcagtgttcaagaaggaatcgaccagctaacacagctcctctggttccaaccaataccccagagccacggtcaactgaacacaggttagtctgcacctctgaaattctagaaatagaacttctggtacttcctgatggtcagggtttctcaaatcactatgtacctcttagccagagctcaaagatgcacctcagaacaggtggggctgagctgcagctgaggatactatcaaaatgttacaggagggtggaaatttttgcggtattctcagcaaaggtaacagtgcctggcacatcagcaggtgctcaagaatttgttgaataagtgaatgactatctgggcactcagataaaaaaaaagataccaatcttactcaaaaatagctattatgaagaatctcatttttcttgccttttattccttattctgcccttcattttcaccctaagagggtagaggagattcggacatgagatgcattcaccctatgagttaaaccccagtctccagcatgggagttgacaattccattactgaaccatcagtgttccatgtagtataacctctcatgggtttaaa

SEQ ID NO: 264831 - DNA, 407 bp, Homo sapiens
ccgaaactcggcaggcaagaagctggtccggcctgacaaggcgaagacacaggacacaggccaccgccgaggaggaggaggaggagcaggtttcagaggtgccgggaagtctgagccttcgccctcctgctctccctccatgtccacctaggaggctgcctacacctgggcaagggcacccgggctcggctggatttccaggaagacccaccctatgacgactgcccccactcccagaccctccccccagcctgggattgagccctggggatgacccggggttggcaagggaagagctgaaatcgccctgtccttggggaccccaccctttgtgccatctgccgtttccctagtgctgggcatccagtcagccctcaataaatgcttatgaatggatcaacaacaaa

SEQ ID NO: 264832 - DNA, 450 bp, Homo sapiens
gggcggattggccactgggccaggatccaggaatcctctctcctggtctgacccagttcaggaatgcagaggccgcccgccccggcaaatgcgttgcagcaagaaggagagttagacgtagagaaacaccgagtttcagaggtgccgggaagtctgagccttcgccctcctgctctccctccatgtccacctaggaggctgcctacacctgggcaagggcacccgggctcggctggatttccaggaagacccaccctatgacgactgcccccactcccagaccctccccccagcctgggattgagccctggggatgacccggggttggcaagggaagagctgaaatcgccctgtccttggggaccccaccctttgtgccatctgccgtttccctagtgctgggcatccagtcagccctcaataaatgcttatgaatggatcaacaacaaa

SEQ ID NO: 264833 - DNA, 505 bp, Homo sapiens
catctggaccctgattttaaggagctactgtagctcagctgttcttggctgtacgtgattagctcagtcaggttgctgttgtagaaccccaaaagttaggttcatgtacccggtgcacagtaagccaaacactgacacattaatgcttagaaaggtttattcaatttggccaaagtatgagggtgggagaagcagattctcaaatatgaccttcctttgcatgtaattgggggctttccctgatgatcaaagctgctcgtgtcccttggccagtcaaatttctggatgccatcagggaggtcagtatgacctaaggatcattgttctttaaaagaaaaacaagtacgttaatcttgcaagcagcccctgggggttaggatataaagttaatcacttgttagtgactgctctctaccaaaatgactacgtgcgagcgatcctgcctggaggaagctaaggacagagaaagaaaaataagtaaaataaacaccttctaaaataaaaa

SEQ ID NO: 264834 - DNA, 330 bp, Homo sapiens
aattacttctaagggctttctaattactgaaatattttgtgaggagatgctttgaaaggctgctggcaagcctggcttcgggagggttccacctgcatagctgcaaagcatcctgactttgaagggtacgaggttcggtttactttttgctcaggaaggaagggggcggggaagggaggaaagaaagaagattgataaaaagggaagaaggaagggagggaaggagaaaggagggaaggaaagaagagagagaaggagaaaggagggaaagaaagaagagagggaaggagtgaggaaggaagaaaggaaggaagaaggaaggaaggaagg

SEQ ID NO: 264835 - DNA, 331 bp, Homo sapiens
ggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaattctggtaata

SEQ ID NO: 264836 - DNA, 148 bp, Homo sapiens
gatggtcaccccacctccatgctgtggccctgttgggctggttttctgatattattagtaatctacatcctgctctgcttctaggaccacaggaggcctggaaatgtctgcagagctcttaatagcacagcaggttgctgcaatgagg

SEQ ID NO: 264837 - DNA, 186 bp, Homo sapiens
attgggttcttgaaatgtgactaatacaaaatgaggtatgttgtaactgtaaagtacacattgtattctaatgacagcgaaagaaaacaatggaaaatttctcattgataatttttatattattgcatattgaaataatatattgactatacagcatatggagtgaaataaaagctgttaatatta

SEQ ID NO: 264838 - DNA, 580 bp, Homo sapiens
tcaagatgaagctgaacatctccttccccgccaccggctgtcagaagctcatcgaggtggatgacgagcgcaagctccgcaccttctatgagaagcgcatggccacggaagtagccgctgatgctcttggtgaagagtggaagggttatgtggtccggatcagcggtgggaatgacaagcaagggtttcccatgaagcaaggtgttctgacccatggcagagtgcgcctgctgttgagtaaggggcattcctgttacaggccaaggagaactggagagaggaagcgcaagtctgttcgtggatgcattgtggacgctaatctcagtgttctcaacttggtcattgtaaagaaaggagagaaggatattcctggactgacagacactactgtgcctcgtcggttgggacctaaaagggctagtagaatccgcaagctttttaatctctccaaagaagatgatgtccgccagtatgttgtcaggaagcccttaaacaaagaaggtaagaagcccaggaccaaagcacccaagattcagcgacttgttactcctcgtgtcctgcaacacaaacgccgacgtat

SEQ ID NO: 264839 - DNA, 336 bp, Homo sapiens
attacccaataataatatttattgaacacctaccatatgttagtccttatcctttccatgcatgatttctaaggtgtatttcttttaaaattctataatactcttacttaaaagactagatgactcaaggaattgggaacaccatagacagcctttaattttttggttcatccattaaattgtgagtctgtaatacactgagaagtagaagacaattatctgatgacttgtactttatattaaatacatgtatggattccaggtcttagagaaaggacagttatcagccctatacaaacagagtcaaagatcagaggacctgtagaaaagaaaaat

SEQ ID NO: 264840 - DNA, 443 bp, Homo sapiens
cagagaaaataaaaggagaaaagaaggcaattttagtctccttgtaaacaggccctcctggtaaatagacaaatgatatttccttggagaaagagaacttgtctataaaatgtccttggcaagatttctctgtatagatgaattatcgtaaagagaacccagagtctatgaagctggttttctggagaatgtcacataagcttttcaacagaatgggatataaaccagagatgttcggtaatagaaatgctccctgctatgtgagggacctcaagactccgcttagagatctcatctatcctgtgccagagaggaatgttcaaggcagaaagagaaaacctgaagaactattcttgatgttcctgaccttcgtctacttcagctgagctcattgttgatcttcttcatatttgaaaatatttaataaagatttaatactaaga

SEQ ID NO: 264841 - DNA, 354 bp, Homo sapiens
ggcctgtctcaaacttctggtcttaaactaatccctctgccttggcctcccaaagtgttgggattacaggtgtgagccactgtgcctgaccacaaggaactctttttaaaatgtatttattgattttgtggtagatagtatattcatctggcccaacaattaaaaatgaagtcacctcctatcttttttttttttttttttgagacggagtcctggcctgcctcctatctttgtttctcaaccactcagttagttcccctgccaagagaaaaacaatagacaatgtttttctctgtttatctttttaaaggcatttgatgcacacacaagccaataagaatatatcctcctttt

SEQ ID NO: 264842 - DNA, 471 bp, Homo sapiens
tgctgagatagggtctcactttgtagcccagactggagtacagtggcccaattttggctcaccacaggctcgacctcccaggctcaaatgatcttcctgcctcagtctttcaagtagctggcgacacaagtgtgcactaccactcctggctaatttgtgtatttttggtagagccagggttttgccatgttgcccaggctggtctcaaactcctgggctcaagtgatctgcccgactaggcctcccaaagtgctaggattacaggtgcgagccactgcacctggcctgggttttgctgattttggtattatttatcatctacgtgctaagtgttttacatacataatgacatttaatcctcataagaactctgtgacaaaatccccatttttcaaatggtttttaagagaggtaaaatgtttccccaattacaaagctacagcatcaggatacgaagctacagcatcagga

SEQ ID NO: 264843 - DNA, 1902 bp, Homo sapiens
gagagccgggatcccgcccagccgatgtcgcctggagaagcgacgcagagtggcgcccggctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaaagtccccctgcagagagctgttgacctgcttgggtgacatccaagacctgcatcaggaaaaagtctgggaagaaaaagcccgc

SEQ ID NO: 264844 - DNA, 985 bp, Homo sapiens
acccacgcgtcgcccacgcgtcggtggaacaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaaagtccccctgcagagagctgttgacctgcttgggtgacatccaagacctgcatcaggaaaaagtctgggaagaaaaagcccgc

SEQ ID NO: 264845 - DNA, 1230 bp, Homo sapiens
gaaaagctctgggattgggacatgtggatgcggatgcctgaacaacgccggggccgagagtgcatcatccctgacgtttcccgatcctaccactttggcatcgtcggcctcaacatgaatggctactttcacgaggcctactcctggcgctcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaaagtccccctgcagagagctgttgacctgcttgggtgacatccaagacctgcatcaggaaaaagtctgggaagaaaaagcccgc

SEQ ID NO: 264846 - DNA, 1141 bp, Homo sapiens
cctaagctggactgcgcgggcaccgatctcgccaagatcctgcctaagtggaacctggcgctcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaaagtccccctgcagagagctgttgacctgcttgggtgacatccaagacctgcatcaggaaaaagtctgggaagaaaaagcccgc

SEQ ID NO: 264847 - DNA, 432 bp, Homo sapiens
cctccatgatttctgactttactagcactcctgctaaagtaggatagcaacactcaccttttagagacctacacattacaaaaccgagcttacagaatgcacacaataaattttaaaaaaattttttaaagccaacaggcaaaaatatgtctatcaaataactcacgatgttaggaacaatcaacagttgtaaaaaaaattttttttctctacactaaacaagtgaatgtttgcttttttttttccttttaaataaattatagttactgattgtgttcatattatacatagatgggatcagagttggaggttttttataaattctattgttgtggtacattttaatttactaaactgagtatacatattcttggtaactttctaccacctctaaaaatgagtctttgacagaatatattgtgcaaaaaaaga

SEQ ID NO: 264848 - DNA, 820 bp, Homo sapiens
gtccacagatgaaaaaggaagaaatgaaaccatcctcattcacaaacctcataatcagttacaaaagaaaatcccaagaaactcccaaaaagccacaagaactaacaggcaaatcaagccagggtgtttcaacagcgccaatacaagtaagattctgatggatcccactgatgctgaatgtacacatccttagtgacaggagatcacaactctctgaaatggatagacaaccccaaaagtaattccatccaagagatttcattctttcaatcatcagtgcttcctgaagttaacaagttctccatctcatgttctccactaatagtcttcagaaaaggccgtttaagactttaaaaaaaaaaaaaaaagagtcagacttctgatatccagttccctatggatggagcttgtaagtcatcactccatcataacaataagtaaaaagctgaacagattggaaaaaaaaatttaaaactcttcttttatccatgataaagatggacaacacaggacaaaccacagtcccaacacaggaaagagagaggtgagtacagggatcacagcttacttgagctgagtcatgagcagaaacaactgggggaggcagtgcctgggtgagagaccctcaactgtaattgataaaacctgctggagcctcaatgtggacaagtctgagaaataaaaactccaggaggacccattcataaggcagccccacactcatgagttttactccaggagctcaaccaagttctcacagtaaatatcagaaaaattccctcatgctttcagcaaaacaaggggaaaatgaaccattttg

SEQ ID NO: 264849 - DNA, 467 bp, Homo sapiens
gtccacagatgaaaaaggaagaaatgaaaccatcctcattcacaaacctcataatcagttacaaaagaaaatcccaagaaactcccaaaaagccacaagaactaacaggtcagtttagaatgatcagtctacaaaaaacaaactatttctatatactggcaacaaataattggaaattgaaattttaaaaataccatttatgatagcattaaaaaatatcaaatagtaagagatgactctaacaaaatatgtgcacattacatgtgcttaaagttataaagcaatgctaaaaagacactaaagaaggcctaaataaaaaggtattgttatgatgtcaattctctccagttagatttacagattcaatgcaacctcaatgaagtcatcggcaagctttttatacgaagtaactagctgattcaaaaccttacatgaaaatgccatggtccaaaaataaccaaagcaat

SEQ ID NO: 264850 - DNA, 344 bp, Homo sapiens
ccaccggtccccttgcttgtggaaactcacatctcctttaaggcctgaaactgaagtcactccttccaggaagcctccttctaaaaatgtctttcctcctgtctttttgcttccagagaactttgaagatggatatggaatttctaggacgccgtgttaaattagagttatgagtgcatatgtcttttttcccgctaggcagtgagctctgaatgcaagcctacttatgtttgactttgtactccccacagaacccattccggtaagagttcatgctcttgagctggcatgggggctggccaggcctcggggtgctgtgtgtggccagggaaaaaaagatgact

SEQ ID NO: 264851 - DNA, 417 bp, Homo sapiens
cctttccacagcccctgacaaccatcattctattttctgttgctataaatttgactattttagatacctcatgtaagtaaaatcattttagtcttttttgtgactggcatattttacttagcatcaaggttcatctatgtagcatgtgtcagaatttcctttttaaggcagaatgtatataccacattatgttcattcattaattggtctgtggatttgggttgctttcacctctttactgtcgtaaataatgctatgaacatggatttgcaataaaacattttgtggccgcgtgtggtagctcatgcctataatcccagcactttgggaggctgaagtgggaggattgctttagcccaaaagttcgagaccagcctgggtaacatagtgagagctcgtctctacaaaaaataaatt

SEQ ID NO: 264852 - DNA, 363 bp, Homo sapiens
cagagaacaaaaacacatcagctcatgaaaattaccagcagagccgcccttactcccagttctcatctcccaaaacaacaacaacaaaaaacatatagctgaagaaaacaagcaaaaatccaaacagaattaaacacccctctttgggaaaattaaagaacattctgaattgaaattcaaaaactaagattagaactgaagcaaaaaaaaaaaaaatacaaataatgagacaagagttgactaacctcagacatggcaaacaagaaaaaaattatattacaaatgaagactatattacaagaaagaataaatttgaatggaaacatgataaacattatcggacaaaagcagaaagagaacaaa

SEQ ID NO: 264853 - DNA, 362 bp, Homo sapiens
agagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccagtgcttca

SEQ ID NO: 264854 - DNA, 506 bp, Homo sapiens
tgctcactgtccatcattgccccatccagccacactggtcagctttcagctctgggaacaacctctgtttacagggtctttcctccacctggaataccggcccccagctcttggctatctccttctcctccttctgggattgggcattggatgaaattgcacctgcttagagaagcctgtcctgacacccacctgaagtagattttgtgctgttgtctccaccatccacacttgtcaccattgctcattgcttttgttcacttgtttgtttactttagtgttgataggtccccaagactgtgctctccatatgggcagggaccaaggttgtcttgttcacgattgtgtccatagtgccttgtacggtgcctgttctgtagggatgatagatccttgtgaatgaatgaatgagtgaatgaatgaatgaaaaggcggaggttgcagtgagctgagatgagccattgcactccagcctgggtaacaagagtgaaactccgtctcaaaaa

SEQ ID NO: 264855 - DNA, 615 bp, Homo sapiens
tgctcactgtccatcattgccccatccagccacactggtcagctttcagctctgggaacaacctctgtttacagggtctttcctccacctggaataccggcccccagctcttggctatctccttctcctccttctgggattgggcattggatgaaattgcacctgcttagagaagcctgtcctgacacccacctgaagtagattttgtgctgttgtctccaccatccacacttgtcaccattgctcattgcttttgttcacttgtttgtttactttagtgttgataggtccccaagactgtgctctccatatgggcagggaccaaggttgtcttgttcacgattgtgtccatagtgccttgtacggtgcctgttctgtagggatgatagatccttgtgaatgaatgaatgagtgaatgaatgaatgaaaaggcggagtcacttaaaagaacaaaagcatttgtaatagacttgctattcctgtttattctttgaaatttgaggtaattcttaactagccacttaggatctccattaagaaccctagtcaagacctttgggtattacctcaaagtaaaacaaagtgggagtattttggatctttggaagttaactt

SEQ ID NO: 264856 - DNA, 322 bp, Homo sapiens
ctgcctcagcctcctgagtatctgggactacaggcgcccgccaccatgcctggctaatttttttgtattttttagtagagacggggtttcaccgtgttagccaggatggtctcgatctcctgacctcgtgatccacctgtctcagcctcccagattaaacaacatacgtctaagtaatatatgagtgaaagaaaaagtctgatgaagagagttaaaaatatttgaaataaatgaaaatataacttatcaaaatgtctaagatacagcaaaagcagtgcttagaaatttatagtattgaatacatatattagaaaagaagatt

SEQ ID NO: 264857 - DNA, 401 bp, Homo sapiens
aatagtttctccatttgtttcagggattcagcttataaacaaaagccaaagtaaggaaataatatctagaatgtggaataaattacatatttaaaataaagaaatgtaggctgggtgtggtgggtcatgcctgtaatcccagcactttgggaggctgaggcaggcggataacttgaacccaggagttcaagaccagcctgggcaacatagtgagaccctgtctctccaaaaaatacaaaaattagctgggtgtggtggtgctcacctgttgtcccagctacttgggatactgaggcaggaggattgcttgagcctgggaagccgaggttacagtgagctgagattgtgccactgcacttcagcctgggtgacacagtaagaccctgtctttaaaaaaaaaa

SEQ ID NO: 264858 - DNA, 664 bp, Homo sapiens
aaggttaacataaggctgggcgcagtggttcacacctgtaatcccagcactttgggaggccgaggcaggcggatcacctgaagtcaggagtttgagaccagcctgatggtagtaggaggtggggcctttgggaggtaattaggcttagatgagatcgtgagcatggagccccatgatgggattagtgcccttataggaagaggaagagacacccacagcttcctgtctttctgcttagaacagaataagaagatggctatccatgagctaggaggatagccctcatcagaacccagccatgaaaccaccccgatcttggacctcccagcctctagaactatgagaaataaatgtctcttctttaagtcacctagtctatggtatttagttataccagcctgagctaagacaccagagtaattaggcaagaaaaagaaagaaaaggcattcagattaggaagaagtaaaattgtctctattcacagctgacatgatcttaatgtatagaatatctaaggaatcaactaaaaagcttagaactgattaacaaattcaggatggttgcaagatataagatcaacatacaaaaatctggtgaatttctacacactagcaatgaacaaaccaaaaatgaagttaaggaaatcccacttaaaatagcatc

SEQ ID NO: 264859 - DNA, 372 bp, Homo sapiens
gtacatagccatcatggaatactatgcacccattaaaaataatgaaataatgtctttgcaacaacatgaatgtagctggagggcattatcctaagcaaactaacacagaaacagaaaaccaaatactgcgtgttctcacgcagtgagagtgggagctgaacatcaagtacacatggatgtaaagatggcaacaatagacatgggtctactagaggtggtggtgcggcagggtgggggtgggggttgtgtggcagaggaacagctgaaaaactacctatttgatactatacccagcacctgggaaacgggttcagtcataccccaaacctcagcatcacacagtatacctttctaacaaacttacacatgtat

SEQ ID NO: 264860 - DNA, 369 bp, Homo sapiens
aaataacactattaattttgtttggaccaaaaaaattttctccacattcataagcaaaatttatttcaattaaacacatatttatgaaatacagtgcctggtatttgaaatcatcaccattgttatgtatgccaaatatctggaggaaaagaagagaaagtggtcatagatctgaatatttaaattacatgatgttgaatacatctatttggaaaaatcttattaattctaaattctttactttttacccaaatattgggcatttatatagatatagcttgcatcttgccttactttacaatttaattccccctaccaaattgctcaaaccatacttctccaaagattctatgagttagaccaaatata

SEQ ID NO: 264861 - DNA, 394 bp, Homo sapiens
gtttttcttatctgcaaaatgacaataatgatttttttagggttatattgaagatgaagatactgtatgagatatattgtggacgaggtgactctaatgtctcctctgcctagaatgctcttcccttgtccaccttgacgtggtcacctcttgcccacctttagcttcataacttgctgcctcatgggagcatttactggtgtggcctccagcctagggtagtttccctccaaattccacacttctttttatgcttgtcatacttactcctacttgtcctctgtctgccttctttctaagatgttaagctccatgagggaaatgtctggcttgttaaccactgtttcctaaccttgacacataatgagtattcaataaatattttttgaatgat

SEQ ID NO: 264862 - DNA, 440 bp, Homo sapiens
aagagtacagtatggaaagggggggaaaataataataactttatcatggagaaagctgacaaacaccccctcagccagggggccaaggttgacatgatgtgatgaggacagtgcttaactctgtggtctccctcccgcaaacccacaaccccagtcgaaccgtgagagacacccaaccagtcctctgcaaaactgtcaaggtcgtcaagaaccaagaaagcctaagaaactcacaaccaagaggagtccaaggcaacaggatggctaagtgaaacgcggcaccctggatgggatcctgggacagaaacaggacgcgagggaaatactggggacatctgaatgaaacatgggctctaataataatctatgacaacatgggcccattaattgtggcaaacgtatcatacgaatgtgaaatattaataacgggaaactgggat

SEQ ID NO: 264863 - DNA, 560 bp, Homo sapiens
ccattttagaaatgtgttgtcattagttaagtcctcttaaatagattattattattttcctatagaaaatgcagaggcctgaggtgaacgcaagggtcataggcatccattaagatacataactatatagatatcttaaaactctgtcacattgtttccttaatcccttagacctatttcctcccatgaaaactatcataagctatgcttttgttatggtctatagaattttcaaaggacaaattttttttttttaggataaagatcttgtgattgtccgtgggctcacatggtttcttttgttcaattttttcaaaagatttctttttcaatactgttgtcccaccatgatagttgacatggcatgtaattacagacagaagtgtgactgtaaacatattagtgtttctgttagtgttggcataagcttgcctttttgtttaaacaatggaacatgatttaattttatctcatttgccttttgtttatcttcagtccttgatttattaacattttgccaattgaaaacacaataaaaaatgccttgcaggaaggtttga

SEQ ID NO: 264864 - DNA, 355 bp, Homo sapiens
acacatgtctgtgttttaaaacggagttacccccatcatggataacccagcctccacatccacctcatgttgatgttgaggaaaaacaaagaacactggaaagtgtaaactgcgtctgttctggaacagaaaatacctccaagagggactgatttccacatggagtttagtagctcagcgatgccacccacaaaagcagatcctgtgtttgcttttgtgtcatgagactctggagacagaatgaagacatgcttttatgcatgcagtatgattttgtgattagggttttgttcctgggctgggcttgacaaagttcttctgcaaagagtagtaaatattttaatctttgcaagtc

SEQ ID NO: 264865 - DNA, 303 bp, Homo sapiens
gcggctgtaggggagcagcggcagtggcggcgacggcgaggaggtgttcggtttgcgcagcgtagaaacgcccgcagcttcagagaaggagttcttgtgggaccaaattaggcattctgaacccacgccggcttagctgggccgagtccaggcgctgccgcacgtacagttttggtggcggtgacagacactgttcttgactctaggggcctattaggccgacgtctgaggcgcagatcgctggctctcgacgcattactctttacgccttacatttctgtcttccttcctgggtcagtgatt

SEQ ID NO: 264866 - DNA, 209 bp, Homo sapiens
ctagagggccgtgcaccatggcctcaaggaaccaaaagtgaccaggaggtggcagaaagtctcaggcatcgcagcccccgactgcacgccactagcccttcctgctctgcacatgctcatctcacttgccagccacacggggtgaagaagttgagatcacccgctgcagtctcagcttgtggccctgccacccacaaaggatcaggtac

SEQ ID NO: 264867 - DNA, 210 bp, Homo sapiens
acggtgctttgggttgagtgagctggtgagtgaacacgaggtgaacagtggatgtcgctttttcgttatcattggaaacatctgattgatcacaacaagcttttcttttttttttttttctttttttgagactgagtctccctctgtcaccaggctggagtgcaatggcatgatctcggctcactgcaacctccacctgctgggttcaag

SEQ ID NO: 264868 - DNA, 447 bp, Homo sapiens
tagtttctgttatctctgagctctattagagcacacagtatttactgaataaaatggtctgtcattaatggcacaaatattttcctagctagtcttttaactttatgttttcttacacagtaaaatttagtttcattgagttaaatctatccacgttttcctttaaagcatccacgttgatgcttgttgtacgcttaaggcctttttcacccccaagatcaggaaaatattcacccacactttttatatctcattctagttctctaaaaaattttttggtcttgctgaattgagcagaattacattttttgttttgttttgttttttgagacggagtcgctctgttgcccaggctggagtgcagtggcacaatcttggctcactgcaacctccgcgttcaggtgattctcctgccttagcctcctgagtagctgggattgcaggcat

SEQ ID NO: 264869 - DNA, 403 bp, Homo sapiens
ggctccagcatacctccaccctgagatgtcctcacacatcagacgctgacctagcagagcccacactatcttccagtaaagaagaacctgcccttacagagaactgggcgcgcagcactgcagtagcaccttaaggacagcagcacagtgtcctggacttgccaccagtgtcaactctgagtgtagacacaactgaaactgttccttcatacacatgcagttcagctttcagacactcaacaagagccttgacaccctcaagctggggtgaggacacagtgaggaggtgccatctatgaacgaaaaagctggttctcagcagacaccaaatctgctgccaccttgatttggacttctcaacctctagaacactgaaaaatatatctgttgttcataagcaact

SEQ ID NO: 264870 - DNA, 786 bp, Homo sapiens
tctggaaaaaaagcattcaaagttgagtggaaaagagttggaaatatattttaaaggtaattatagaaaataaggttagtacaaaattgacaatgttgttatgtttctataatatggttatgaataccttcaagttaactctaggttaacaagcttgcatgtttcttacccttactcattcttactccatagacaaaaggtccaaatcactgacactattcactagaaaggagatttcttagtaggcatgtgctttagtattgaatatgctgtaaggttatttgtattttctaaaaagtagaattccaaaattagctttttgttgttaaaaaaaaaaaagaaaactagtaacccatgtatttttacctaaaacaaggccacaacccaacctaactgcaaacttcttttagcttaaattgtacccctctttggttacttcaaaaaaaaaaaaaaaaaaaaaagaaataccaaagcaagttttcccttcctcttatctctcagtgtcttcgtagtttagtgaaaattttttagtgtaagcaacagtaaacacatttactaagtccttttatttacctttttaaggcagttttacttgaaaccctgatagaataaaattgctgtggaaaaaataggattgagatggtttctgcctgtttgtgaattgagatcatacctacatgagtgggagtgaataacatatttgcagtgaggctgtaacatagatacaggttgatcatccctaatccaaaatcccccagaattcaagatgctccagaatctgaaaca

SEQ ID NO: 264871 - DNA, 1187 bp, Homo sapiens
aggcagagagcccgaaaggaccagacgcccaggtcgcccgcatcccgctgccgcagagagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctg

SEQ ID NO: 264872 - DNA, 1084 bp, Homo sapiens
atctagaggatcccagtccgttcgatgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctg

SEQ ID NO: 264873 - DNA, 722 bp, Homo sapiens
gttgtcagaagccctgagaaatcagcttggaactaataagcccttgacctttcagtattggtgacgtacttgagattccagctgtccccagcttctgcaaaagggaggacattactagcttactaataataatttaatagtgtgtgaagaaatcaggggatgattctctttggtggaattaagtctatttctcagtcaagaagaaagcaatttataagtaaagatactcggcagtgctcagtggtatagtggagtcctggactctgggactgagttgtaaggtcagcgtaaaaagcaacactgaagttcagtcagaagttcccatgaaaattccttagggtttccctggaggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcagtaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaa

SEQ ID NO: 264874 - DNA, 388 bp, Homo sapiens
cccagcagagccagtgtgggtgaggctgggaaatgtgtgggcaggacctaggtcctgggaagccccagtctggcccacactcacttccacagacccattttcacacccccgttgtctggcctaactgatcttctgggcagttcccaaacacacccaagcattcgtctgccttttccctccccaccccagcaccctctcagccacctgaagctactgtgtcctttaaggcccagttccagcagcacctccctctttctccagagcctgtcctcagcctctgacctgtcaggcagctggccttggaagcatcacatgttagagccggagaggcttaatcatctgtctattctatggcttctgctggccccagatcttcctctggtaacaa

SEQ ID NO: 264875 - DNA, 444 bp, Homo sapiens
cccaacatataaactacaaaggaccacactgtgggcagttagagtgaagtttggtgtactagtttcatttttcataaaagaaaaagtcaagaggaaggaagcaatgctgtaagtttagagaagagcctgatgaatttgaagtgctggtaagcttagttagtaataatgccacccaattttcagataccttttaacatttgtatagcactttactcatgatgtggcacttataattagaaagacaggataggcaagtggaattagcctcattttttacaggtgaggaagttgatgcagaactttagcttaccatgtacgaatagcttgcaggtggtgagattgggacttgatccatatcttcatactttaagttcaatatttttcctatatcctcccccactcccttccccacctggcttggaggccgcctagcaatcattcaaa

SEQ ID NO: 264876 - DNA, 307 bp, Homo sapiens
tcctttcgcaacttagtggtgctgggacaactggatatccacatggaaaaggatggactgcaccctccctcaccctacacaaaaaaatagctcaaaatggatccagtgtaagagtcgatactgtgagacccattttgtcagtctgctgggtaccgtaacagacaccgcagactgtgaggcttaaacagcatcttatttcctttgttctggaggctggaagcctggggtcaaggtgcaggcagggttcgatcctccgggtcctcaccccattctgtgtagacggcgtcttctctgtgtcctcatgggt

SEQ ID NO: 264877 - DNA, 512 bp, Homo sapiens
tatttaaaagtatatagataaattacctgaaggaaaaaagaaaatattataagtggttaaatgacttacagccatactgacggttaattccaggcttacattcaaacccatatactctggataataggattatggtttactaagaggggttttgtttgtttgttttagcaatttctatatttctataaggagcaagaattttataaaaataattattatatttacatatctagtttattatattaactataaaccatatctcaattctccattttgtggtatgttggagggacccttcccttcctttccctttcccttttccacgtcgttggctcttacattgtcaagtctgataattcttaaattctattctgtaaccagttaggattttatgtttggttattgattgatttcaaaagctgaaaataaacagcatgaacattattacaaccatctgaatattgttgattgcagatcttagcttactgtgtttatatttccttttgggatca

SEQ ID NO: 264878 - DNA, 107 bp, Homo sapiens
tcgctgcttccatccctccgctttgggggaactgcctgctggtgttctgggttctctatcaggggctggggaaggatagaacagagggcggagcgcgcgcagggtgg

SEQ ID NO: 264879 - DNA, 203 bp, Homo sapiens
aaaagcccggaaccccactccaccctcaagtcagcttcctcccagcaggcagggacctcgccacagtcctcacagggccgtctcttgcctcggctgcctccacctccagcctagaggcaggacaggcatcgctggccccttggatggctgagagcagagactcggagagggaaatgagcacagtgtgggggtgaggctgggct

SEQ ID NO: 264880 - DNA, 427 bp, Homo sapiens
ctgttttctaaatttaggtcttcttatagcccttctattccttattttacaatagaatatcatttaagtgacatggaatggaatctataaatattttaacattttaaaatttattcaatatattttcctcaaacctcttatgacagtgaaagatttcatctagacttttaatatgtaactattaactatagcttcattttactagattttaaagctaattaaaatatattctctcaaaaattactatagcttacttagaaataactgtctctgaattcctaaggataattttaattctcgttttaggcttaggtaggcagcactaggattctataattccaagaatactttatttttgaagctagatgcataatttttcttcatatcagggcatcctgaatcaattgatgtctttttctttaatctg

SEQ ID NO: 264881 - DNA, 504 bp, Homo sapiens
aaagagtgagggcctgacaagaataatgtactgttaacccactgaagggtaggagaaaccaatgtgtagactagataccacaagtctgtatgagaaaacactctccttccttcatctcctccctccttttccttccttcctcgctcctttcttcctctttcctttccgtcctctctttcatcctccttccttccttcttttttttctattactttttaagaaaatagaagaaatcttgatgatcctgagtgggtcatacaagaaagcaagtcatgactaaccacttactataatccttgctagaaaatcagaaagggaaatgagcaaaatttagaagttaaacatttattaagttaaaaactgaaactgaatttctcattgtttcctagggacgacaatgtcttgtttgcaagggggagcttgttgcccatgccttactaaattgttcttcctaatcagcttcacagcgtttgaggtgatccttaaatgtttgcgcagaccatc

SEQ ID NO: 264882 - DNA, 387 bp, Homo sapiens
atatatatatgttaataactcaccacagatctataagtggatactattattacacctgtgttacaaatgatgaaataagaggccgggcttggtggctcacacctgtaatcccagcactttgggaggacaaggcgggtggatcacctgaggtcaggagtttgagaccagcctaaccaatatggtgaaaccctgtctctactaaaaatacaaaaaaaattaggcgggcgtggtggcatgtgcctgtagtcccagctactcgggaggctgagaccaggagaattgcttgaacccaggaggtggaggttgcagtgagacaaggtcacgccactgcactccagcctgggcgacaaagcgggactccatctcaaaaaaaaaaaataataaaaa

SEQ ID NO: 264883 - DNA, 143 bp, Homo sapiens
gaccttcctcatttttctctctctcatacacacacacatacatacacaaggacagaagcacaagaatgtgtataggaatccattataaagaggccgaaacgaggccaggcgcagtggctcatgcctgtaaccccagcactttg

SEQ ID NO: 264884 - DNA, 385 bp, Homo sapiens
aagatttttctatctaataatatccagaagtgctctgggtctttaggaaggccccgtcacaatgtcaaaattttaattcttcccataataaaaaaactcattaatattagggcagtaagaatgccaagtagaaattgtacatctttctgagcacagtggcttatgcctgtaatcccagcactttgtggggcccaggtgagcagatcacttgaattgaagagttcaagaccagcctgtacaacatagcaagaccccatctctactgaaagtacaaaaatttgctgggcatattacatgtgcctgtagctccagctacttggcaggctgaggatcgcttgagcctgacaggtcgaggctgctgtgagccgtgattgtgccactgcac

SEQ ID NO: 264885 - DNA, 461 bp, Homo sapiens
ctggcctccttgtttcttcctcctttccttggccagttcttactatttttaaagattcagatcaatctttctctgaaagcctttcccgattcttttctttcagtctgcttttcctccttcccccaccgccttccttccttccttccttccccgattcacgaccttttctcacaacttgcctggttaattacttctctgaacccacatgcttccatatggcatttaacacactggcttgggatttacttttctgtttcctctgagtcccacattgctctctgaagggaacgaatgactcatcatccttgtattgcctgtgtgtgacacatagtaggcattcaaaaaatatttgagtgaaatgaattgttcattcagacatccattaaaacttggtagggaaacagttgattttagtagcataaatgggtttagaagttatttcactcaatttactcatgctt

SEQ ID NO: 264886 - DNA, 409 bp, Homo sapiens
cgactttccaaaaaccctcatttctggcattacagcctgtggcaataacagagttaaggaaaggtaagtgaaactcagagagacacagtgagataattattcctcacgcctgttagaagaacattccaccgtctcagaagaagccctgtctgaatctgattcagctgagaaaacaactcaggccatggtagctgcacccaactctctaaatcaacagtgacctgtgctgaagggattaaggcatcccaacattcctcagagcccaaggcaaggagaatcccttatgaagatgaaattgatcttcaagcaccctctaccttactctgcgtgatgccatattcttcctgaatcccacccaactcaagagcatgatttgcataataaaatctctaatactttgatgaacaaa

SEQ ID NO: 264887 - DNA, 786 bp, Homo sapiens
aggcagagccgggcccaggccagctgcctgtccagccctgggatgagaaaaggcgtcaggagatggaccgggcctggttcgcctttaattggctgacccgtcctgtgggggtaactgatgcgtgaacagccaacaattgggccctctggccgggacaaacacgtgcgtttggggagtagaagaaggctggtattaacctccattttacaatgaggaaacggagtcccaaagacgttcagtcatcttcctgatattcacacacttacaccctggtcaggccggcgccatatgtgttttcaccagcagaagggactgccagggaacagctgaggggaccagagctgggatgggcctggataattatagcggaaagaaaaacacgccgagcgcatggtcctggcagaagcagcgtggaaacagaagtcaaggcagattatttctgccatgaggagatcttgccatgtaggaaaaaagaaagaaagagaggaaagaaagacagagagagagagaggaaagacagaaagacaagaaagaaagagaaagaaagaaaagaaaaaaaaaaagaaaagataaagtttttttgtggcactgtgagtctccctccgccaggttctctagattatgcgatgagctctgtctggctgtgcattccggagaggctcggcaaatttgctgtgagattgctgagcaacagcagaacagatgcaaaggcctgcagaccaaaaattgtccccctggctgtccaaacagggaagaatctggattccagaaactatatacttatta

SEQ ID NO: 264888 - DNA, 446 bp, Homo sapiens
agggagggccaagcagcccccaggcagacccctggaccgttccccagtctgcactgccgcctcagggacctccccatcacctcagcaagcgcccttttctgtaaggagggggtaagaacacctgccctcgggtgatgtgagaagcacactcacgcggggaaacaggtcttagtattttcttagactttgttttgttttgttttaaggcagggtctcactctgccgcctagattggaatgcagttgcatgatcttagctcactgcagacttgacttcctggactcaagcaaccctcttgactcagcctcccaagtagccaggactataggcacacaccaccactcctggctaacttttaaactttgtgtagagatgggggagtctctctgtgttgcccagagagtttgagaccagcctgagcaacatagtgagaacctgtctcaatt

SEQ ID NO: 264889 - DNA, 299 bp, Homo sapiens
gtaaattcaacaacagaaattgaggatgaggaacatggtgttgcagttcaaaccagttccagccaaaatggactctagtcacaaacaaatagtaataacaatccaaacttgtggctgaatagagttctgaagttttgagaaagagccaagagaaaattcagtgtgaagatgatggagtgacacaatagaaggaacctgaatcactgaatcatcacttggaagaaagcagcccagactagttacccaactcccatcagacagtgaccagagtgagaaataagccttgtgtatggtgtgtg

SEQ ID NO: 264890 - DNA, 305 bp, Homo sapiens
aacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactgg

SEQ ID NO: 264891 - DNA, 373 bp, Homo sapiens
actgattactgacttatgttccctttcgctgtgtagacagggacactcagggcagagaggggcaaggtgtgtccagatactcccaggtcggattccaggtacagaactggaactcggaaatacccaggtttcccaactctgggtcctgtgctcatttttgacccatgcaactaccaactgccactgaatcattctgagatgaacccccctgtaaagaacacccccttcccgagacaagcaggagtggtgcctctgtatgtcacctaggaaagccccacgcccagcaagcccaatggcctccactgccacataccgtttcctgcttcagaaacttgcagcaggacatgtaactcagagccaagagggtgcagca

SEQ ID NO: 264892 - DNA, 401 bp, Homo sapiens
gcaagatgggtccccatcctgctccctctgcactgtcctccctctcccacccccagaggtcccagtgaccatcgtgcgggggccacacgacctagaggtgaccgagggcgacacagctacgttcgagtgcgagctttcccaagctttggctgatgttacctgggagaaggtcagatcccagccccagccaagcccacttcagtgtaacaccaacgataataatgccccagacagaaacagctaatattccttgagcggatgtgcctggcactgtgctaagatttgcattatatttaatcccttactccaaggacaactctaggaggtaggtcttgtcactgtaatacctatcaggaaactgatgctcagtgggaaaaattacctacccaagggcagacaac

SEQ ID NO: 264893 - DNA, 496 bp, Homo sapiens
ccactcaaggcacatacaaagctagaatgaagttgagtgtattatccaactatttaacttattgaacatataattgacaatgtctaccaatatagccactattcctgagctagatttccacaaaacattccacgatttcccttaatggtggttgagtgatacattgaataaatattgtactgtaggataaatttctgtaagaaagtgtcttcaaagattttgggtttgaggtatatattctttcatgttttgcagtgaaggtgtgtttttcttccaatagttcttagtttacattttctttcattggaagttcatcactgttaggcgttatcttgagtattataacaaagcaaatccacaagtattcaatataagattaggaaaaaaattcctgcgatactttgttgtcaaacacttgccactgatagacgttattttagcttttaaggcctgtcacattgtttattcagaggaattgtttttcaaattttagtaa

SEQ ID NO: 264894 - DNA, 218 bp, Homo sapiens
aaggaagggaagaaggaagggaggaaagaagggagaaggtaaggagggagggaaggaagaaaaaagggaagagaggaagaagggagtgaaaagctacatctgtccgtccattattaataattcatcacaaatctttcatttcaggataaggaaatgtcattaggccctcaaggaaaaaaatgcctgttttcactctgggcttagaattcttttctctt

SEQ ID NO: 264895 - DNA, 259 bp, Homo sapiens
accaacagacttgctcgacgctgggttgtcacaaaccctcaactcgtaaaaaatgcaatatccgcaaagtacaataaagtgacgcacagtaaaacgaggtgtgcctctatatgtataaggtttaccttgattgtgttgtcgaggttttctacgtacttaatttctgtcctcttgatctgtcttggactgagtgtgtgttaaagtctcactaaagaaacattggtgtgtctctatctatactttcaatccctggactttt

SEQ ID NO: 264896 - DNA, 2160 bp, Homo sapiens
  misc_feature (884)..(885): n is a, c, g, or t
  misc_feature (889)..(889): n is a, c, g, or t
  misc_feature (891)..(891): n is a, c, g, or t
  misc_feature (1105)..(1105): n is a, c, g, or t
acggtgcgcgcacccactgacctgcgcccactgtctggcactccctagtgagatgaacccggtacctcagatggaaatgcagaaatcacccgtcttctgcgttgctcacgctgggagctgtggaccagagctgttcctattcggccatcttggctcctcccccgggtgttggtgtccctctgttgcccaggctggagtgcagtggcaagactggctcactgcaacctccacctcctgggatcaagcgatcctcccatctcatcctccaggagctgggactaaagaaagaaacttataattcacacttttgttgatgaggagaccaggacagaagaagcaagagacagttgaccattaaacaacacaggtttgaactgagtggatccacttatatgcatacgtgcattttctcctgactcggccacccctgagacagcaagaccaatcactcctctttgacttcctcctcattttactcaatgtgaagaccaccaggatgaagacctttatgatgatccacttccacttaatgaatagtaaagatatatttcttattattttctttagaactttttctctagcttactttattgtaaatatacagtatataatacatattcaaaatacatgttaatcaactgtttatgttatcagtacggcttctggtcaacagtagcctattagtagttacattttgggggagtcaaaagttacacacagatttttgagtgtgcatggggttagagtccctaaccttcatgttgtccaagggtcaagtgtataatgtttatttaagcagagacttattttagtgtatttaaatttttggtcacagattttttgacttctgtgggtaggtaatgagccaaggctctaattttttnntttntnttttttgtgggagccttaagcctggatttgggtcacattatataaggatgctattaatttaagtagtagagcggcaggctataattgactttgttgagttccaggtcctgtaagtacatggcttccaacagagtttccattctctttatggtcgatggagatgctcaccttgagcatggccatatattttataatagttttttttttaaaaacntatcattatcattgcaataaattacaaatatagaataaagcaatttccttaacttattctactattttgaaatatgtcaattgtcattatatacacatttaaagaaacacatacacatgcacacacacacatcatagtactgagcttttcaatgttgtatcttttcaagcagacccttaccattgggcatgcaagtgtgtatgtaggcaaagtggtgctaagtggcactactggtcttaaaaagtcttattgaatttttaatacttaaaaaatacctttcatttttgtacaatatatattgaccttcattttactaaatatcacatttcacaaaagatcttagctaattgcaataattgagtaaacaagaatataaagtataatatgcttttaaaggatgacaaggtaatttcaagctcttttagaaacattttacagcagatgtttgcatataatgtgctaatttcaaatggtgcttatttaattcttggaggaagctatgtcaattattctccatttggagaaactatacgtcctttagaatgaccccaagtatctcagagccttttaaaaaataatgtcttctattttaaagatatttcaaccatttttagcagactcagtagctaaactcaaaaagtagcaatgtagtggaaagagaacacattttaatgctaagcaaatctgtgatctgaaacctaccttctattattttctaattgtttgaacttaggcaaaattaacttctctgggtctaatttttaacatattttttaagggaagataacaatggctatctaatttgtagaactctgagtggtttaattgagataatgagtataaatttcattatatgggactggcacagaattgatgttcaatatgtgttagtttcagttctatttatccaacatctgtgagattttatcctaaaatgtaaatgtgacgattatgtgcatctccatccagtcagccttaatgagtaagattatgcttaccagctcttgtatcccttcatgtcagaacaataaaagctggatcaaaaatagatttta

SEQ ID NO: 264897 - DNA, 865 bp, Homo sapiens
ttttatttagattctttcttagaatttccatctgtcttcttacattacccatctgttcttgcatgttatctactttttctagtagattccttagcatattatttgtagttatttcaagttgctagtccgataattccaatgttcctgccatgtctggctctcgttctgatgcttattctgtctgttcaaactgtgttttttgccttttagtaagtcttgtaattttatgttaaaagctggatgtgatatactggataaagggaactgcagtaaataagccttttataatatagtgataaagtaaggtatggaggggaagtgttctgtagtcctatgattaaggggactaggtctcagtcttttagtgagcctgtacccctggacttagaacttcacaagtgcttctcagcccttcccccaccccccaccaccttaggtgggataggatggttacaggttgctgaagttgggtttttcttttcccctaggttaactaagctctaatgaaatcccaatcggttaggctctgggaaaataatttaccttgtggacagtccttgttaagagtaacagaatttggccaggcgcagtggttcatgcctttaatcccagcactttgagaggctgagggagtggggatcactgggtcaggagtttgagatcagcctgccaacatggtgaaaccctgtctctactaaaaatacaaaaattagctgggcatgggggcaggtgcctgtaatcacaggtactcgggaggctgaggcaggagaatcgcttgaacccggaaggcggaagctgcagtgagccaagatcatgtcattgcactccagcctgggcaacagagcgaggagactctgtctccaaa

SEQ ID NO: 264898 - DNA, 710 bp, Homo sapiens
cagcctcccaaattagctgggactataggctcgtgtcaccacatctaattttttatttttatatttgtggagttgaaggtcttgctctgttacccaggctggtcttgaactcctggccccaagcagtccttccaccttggcctcccaaagtgttgggattacaggcgttggccactgtacccagccttacttgaactcttaatacttattcccaagtggtacctaaaatggttttgtgcagtcacaatattaggtagcaatattatattgagctggaggaaaaagaagatttaggagtaaattgccaaggcaagttctgttaaaagctttctgtaatagacatcagggattttttttattcaggtaacctcaacagttttgattgcacatgtaacatagtacttgacaggtaatactgatttttataacttcataaaatattctcaagccatggaggagctcttatgtattttttaatgagtacacacacacacacacacacacacacacacacatatagtaaaagtggaggattcttttcttggaataatgatttctagcatttatctagaaaagattttgctgactaaattttccttttcctccagtggatttttaaacatcagtgcatgcacataaatacagattggatttttcctttaggctttatctatgtaaatgaagtcgattaaatgtgaataatcatgtta

SEQ ID NO: 264899 - DNA, 412 bp, Homo sapiens
ctttttagacatccaagttcttagaaacttcaccaaggcatttgaagctccaaatctgtagttttcttagaagtttacttgagggtattcactatcaaaataagggaataaacccagaaaaaggaagacacaagttccaaaacgaaaacaaggagattcaacatagaagaacatcaaacagaattctcttgatgacagaaaaagaaaaagcctcagaataacagcttcacaataggccaagaaaataaccagtacacaattgaatagaacgactgaaagaaatgtccagaacaaaaaaaattaaaataaaaaatgagagttatagattttctgatgtgtttgtcaagaaatgttcattaagaaacagctaggggacttgattatacagaataaggtacatagaaaactaagc

SEQ ID NO: 264900 - DNA, 417 bp, Homo sapiens
attttaagtgctttcttttttatgtttagaaatgttaatttcataaacagccataaagtaattgaaataaaaagatacattgtaaaagctttttatttctatgaaacaactttgattctaataccaaatagttatatcgggaatgtgctacgtttgctttatctgtaaaatgagagatgtcatttttcaattggaggctatggattccaaatcttccatggagttacttacgagattctgtacccattttattataattgcaattttaagatgcatttcatttatttaaaaatgtatttttaaaaataatatgtacactctaattacctgccagttggacatcacagaataaagtttttccaccatctctgtgtatatatttgtactattaataaatgtacacttgattaaaaacac

SEQ ID NO: 264901 - DNA, 538 bp, Homo sapiens
tgtatattgcccagtctcaggtatatctttatcagtagtgtgaaaatggactaatatacttggtgaatgcctcagggggaggtctgcctgcttatctgacctagagccactcccaagttaccaacttggttggggaggcaacatgacttcctggattgagcactggagcaacaatcatgagacctgggcttcaggccaccaagttccagcactaacgatgagtgaccttggcaaactactttccatttcttcttcccattagaggaaaataattgatcttttggtcataccttacaaagatgttgtgaagatgaatgtagaatatctgaaggagcatcagagggaaatgccaaagtgtacataattagttttacaatctataattaagtatatggatagagatgaggtatccatgtgtgaattatacatttaaaaactaggcttgcttttttttttcctttctaacagtagtgaagagcccaattacacctggtgttatattagtagagacgaagacccattaaaaaagttaaatgag

SEQ ID NO: 264902 - DNA, 287 bp, Homo sapiens
agtggaatgctctggttccagaacattttattcttcctcctcctcgctgtattcagtcatacatcccagaagagatcagcaaaaaattaggaagttagaggtttacatttgtctttaaaacctactcaaaaaaatatgctttttacaattgctcttcagaggcctcccctgctctcattatctactataattacattataccttctgaaattctatatcaaaggtcagagcagaccctttaggcatgaaatgattcccagctcttcacggactagaagttcaaagtg

SEQ ID NO: 264903 - DNA, 449 bp, Homo sapiens
ttaactaatgaattactaaatgcatgagttagatgtgaaccactaacaatacttaatggaatatccatatatataggtgaggcttgtaccttgatgactttatgcagtgctgactgtgcaaggggagactcaaatgtcaatagatggaaacttctccccatggtcttttaggtttttcagacaaggctcctcagacttcccattaggcctgagaaaagagaagtaatctcatgacaaaagctggggatgcaatgtggctatgtgtaaatgtccagttggttgcttaatatcaatcagcctcttcctggtaactgttcagcttgccagtccttattttagaggtctttgtccagaaggggatccctggtgttcaggatacagatcctccattgacattctcaacatttcactcctgcacgtgaccctacctggctcttgagcatcaacct

SEQ ID NO: 264904 - DNA, 522 bp, Homo sapiens
agttcaagaaagtgaaatgtgtaatggctatctttcctttctggtttatttcaaagtcaagttctaatataggtaaacaaatacactaataaagagataatgcttttctcatgaaatgtataatctagtaggaataaagataaacaatttttttaaaaattctatttcattaagcaaaaatgcaactcggaagaataatgtacattagcagtcatttactatttttcaataaaattccgatatatatgtaaagtaaattattactaatatcaaacatagtttaaagaattagtgactatgtgcacttggatctccatatgtaatgtactatcagcatcttcacaaacacagtaaattttaatatgcaaataaaacttattttactaaacgatgattactccttctatattcatattcctaaacacatacagtttcttaatgtaattaagtttttaactaaaaaaagggaaatgcattattgaggcgataggattactgggtggctataaacacatctgctgc

SEQ ID NO: 264905 - DNA, 468 bp, Homo sapiens
ggggagccggctgcgtcccctccagcctggtccatcaggctctgacatggccagggagcgggcctgcgagtccccggaagaggtgaggtggccgtcttgtctgcttcgattgcctcgcctccctggagggttggaagtctcgccctgggttagagaacagggacgcaagacggcttaacaagatctctgtaaggcggaaccggggccgggaagcggagcattgagactaggtcagaaagaacctgctcggcacgcagggctactccacctgctgccgcactgacacttcctaggagcctctcctggtgttaacatttctatttccaaaaacatccgcgggaggacggctgtcactgtctccgccgtggggaccttctgaaagattgttaaggagagtcatcttgtcccttgtagtatgcgaagggctgagtactacagttgaaatgatgtttccagtgaactaagctg

SEQ ID NO: 264906 - DNA, 446 bp, Homo sapiens
aaaacctcatgcattattttttgatatctggagagaaacacgtaccctagaaatgctgtggactaattccatggttactttgtcattaaagaaaccaaaatactgagaggtcaccataaacacaaaaaggcagagagagaaggattaaatggtgtttcatgtaaggatctttaaagggagacagaattctagtctgaaaggagcgcaggcagatctggcattttgcttggggagttcaattctttggagaaaatacagagacaaaaagaccattttgatggtatttaaaatatccctctgcccagtgtatctaagtgagtctaaatatattcagcaattttttaaagggcagatattaggcccgattcaaggtatggaatatagattcgaaagggttagtgataggtgagtgcctttcaggtagctttgcatcacagaccaagccc

SEQ ID NO: 264907 - DNA, 404 bp, Homo sapiens
tactcagaagtcgaaggcgagagtatcccttgaccttagctaagggcttcagggcagtagtgagctatgattgtgccactgcactccagcttgggcaatagagcgagaccctgtctctaaaaaagaaaacaacctgctggggagaaaaaatacattacgtgtaaaggattaacaattaggccaacatcagacttttcagttgccacaacagtagtgagaatatggtagcgtaaaatcttcaaagtttagtgaaaaacattggcaactcagaattctgtaccaagctgaactctcatcattcttcagtaaagatagaagaaagacttttactttcagattaatacaaatgagagtttactacccaggatccctatggaaacaactgttaaaagatgtatgttaga

SEQ ID NO: 264908 - DNA, 503 bp, Homo sapiens
aggcaggtggatcaccaaggttaggagttcgagaacagccagaccaatatggtgaaactccatctctactaaaaataaaaaattagccaggtgtggtggcatgcacctgtagttccagctacttaggaggctgagaaaggagaattgcttgaacccaggaggcgtaggtcgccatgagccaagaatcgtgccactgcactccagcctgggcgacagagtgagactctgtctcaaaaattaattaattaaaattaaataaaaattacttctgaatgtgagcacatgaagtattatattcaaaaacaaagctgactggaacatgcagaacaacggaggaaagggttgaatttccctttacttaggagatccttatttaagagtgattatgcttgcctgtcataggagcaaaaagaaagcctaagtgaacctttactgcaagtgagggaaatggtactagaatagaaggaaaatgctttgaatggaagaaaagactttaaaaaaaa

SEQ ID NO: 264909 - DNA, 413 bp, Homo sapiens
ccccagggttcagcacctgcctgaccacacggcatcaaagccgcctgtcctccccagcccccgcacaacctgccactccctgctcggcagaggaaggagactcgggccacacccagggagggacctcctctggctcgacatggaaacctaggctgtagctccctgcttccccggctgtgtttgtgtggcctggtggctgaatctgcacagagagcaggacgccaggtgcgctcccgggaagctgtcctagagaggggccggaccgcacacctggcgctggaagcctccatgactggatgtttgcaagaaacagaaagaaacttctgtccagtctcagccacaggcacgccaggtcctctgctgccttgccgcaagctcgggggtttcagtgagaccctctcccactcccacgg

SEQ ID NO: 264910 - DNA, 710 bp, Homo sapiens
gctggcagtgagccgagattgcgccactgcactccagcctgggcgacagagcgagactctgtctcaaaaaaaaaaaaaaaaaatagttggaagcaacctaaatgtaaaatatagggaattggttgtacaatttatgcgacattcatgcagtgcatttgcaaaaggtaaggctaccaagaacaattatgtagaagaatatttaataacatggaaaatgtttgcaaagtattttatacacacacaaaaaagcttacaaaatactatttacaaacagagatggtctctgaatctttacccagttataaattttgatcccaaaatggacctaactgaatcaaaatgttaatttgtgtcatagggtaagttacctgtagcgactagcagccttggtttcctttgtgacctcacagccttcattcacctcagctctttacttggtgaacacatattgtaagaatgtgaactgatgattggaaacattacttttgacaagttcccatacttgaaatactacaaaaacatcacctaacaagcagaacaaccatgaatgggtagacattgattagacatttaaaaagaaacaaataaaaaagggagatggcaaaaaaaaaaattgtttacatctgttttcattgattgtgttattcatttatcattttttgtattataaaagcagtgtcttcctatggccccccctccaaatcaaaata

SEQ ID NO: 264911 - DNA, 504 bp, Homo sapiens
gcacatgcagtgacaagaggagaggcccatctcagccttgcagcaaggttgccagaaatcgattctcgcccccatcccgtaaagcctctctgcatcacctgcttcccacagcagcagcctgggcctccaaagggcacattcagatttgagggatttggggagtttgtgggcaagggcagactactatgggcttttgggtgaaccccaagggaatgcaaagaagccccctgccattctccatgaatggagctgaatgccctagccccccattcttccacgtgggagtatcctcttgagagtcctgctggctgttggtcaaggcaggttaaaagctgaggcttaaagtagccaggggtagtggctcccgcctgtaatcctagcaacttgggagactgaggcaagaggatcaattgagctcaagaactggaggctacaatgaggtatgatcacaccactgcactgtactccagccttggggaaagagcaagaccctgtctcaaaaaa

SEQ ID NO: 264912 - DNA, 408 bp, Homo sapiens
cctttagtgtcatttaactttgtcgtctatcccacatatttcctgtaagctagaagttagggctagtagctgaattagattcaggttaaactgttttggtgaaaatactttataggggccaggtgtggtggctcaagcctgtaatctcagcactttgggaggccgaggtgagaggatctcttgaggccaggagttcaagaccagcctgggcatcatagtgagactctgtctctacaaaaaataaaatcattagctaggcatggtggtgtgcacctgtagtcctagcttctcaagagactgaggcaggaggattgcttgagcccagaagtttgaggctgcagtgagctatgatcactccactgtactccagcttgggtgacagaatgagaccccatctcttaaaaaaaa

SEQ ID NO: 264913 - DNA, 417 bp, Homo sapiens
tttttttttttggagacagagtttcactctgttgcccaggctagagtgcaatggctctgtcttggctcactacaacttccacttcccgggttcaagcaattctcctgcctcagcctcctgagtagctaggattacaggtactctacctgtaattacaccaccacacccggctaattttgtgtttttagtagagatggggtttcaccatgttggccaggctggtctcgaactcctgacctcaggtgatccccccaccttggcctcccaaagtgcttgtaattctttatactttgttttcaaccataataactttatatgtatatttttaagaactacttgaaaagaggtaaacttgaatctcagaaatgcaagaggtttggcagggagttagaggtagaatgaatacaagtgaataca

SEQ ID NO: 264914 - DNA, 425 bp, Homo sapiens
gcatattctgcgtgctaggcactgttatgagtgctggaaatgcagcagcaaacaaaaccgataaattccccatcctcaagaagtttaccttctagttgagaagtcaaatagtaaatcagtaactaaatatatatgtgtgcataatatatacattatatatcatataattataacatataacaaatatattatagtctgttaatatacaattaataccatatattattatatgatatatatacaacacaccaatatatacatttaattactaggtcatacatttaacttaataatgtcataacttattgcaacttgatgtatcttaggtcatacatctaatttaattaaattgttattaaattaaattgttaagtgaaagttaactgagtttatttccattcataaactgagctggtattgttggg

SEQ ID NO: 264915 - DNA, 334 bp, Homo sapiens
actctatggaattgacataaagacttgcatgcaaaagcttcattgttggccaggcacagtgactcacacctgtaatcttagcactttgggtggccgaggcgggaggatcgcctgagagcaggagttcagcaccaggctgggcaatatagcaagacatcgtctctactaaaaaaataaaaaattagccaagtatgatggtgtgcacctatagtccccagctactcaggaggctggtaggatcacttgagtccagaagttcaagcttgcaataagctatgatcatgccactgcactccagcctaggtgatagagcaagaccctgtctcaaaaaaaa

SEQ ID NO: 264916 - DNA, 643 bp, Homo sapiens
gtagaaacaggcagtcagaggtatagaactacacagaatccaagagatctttcaagaaaagtgacatgcagcaagagaaactatcaagggggtaaacaacctatagaatgggagaaaatattcacaaagtatacatccaacaaaagtctaatatccaaaatctataaggaacctaacaagcaaaaagcaaataacccccttaaaaagtgggcaaaggacatgaacagatacttctcaaaagacgtacatgtggcccacaaacatgaaaaaacgcccatttctaatcatcagacaaatgcaaattagaaccacaaagagataccatctcacaccagtcagaacagcttttgttaaaatgtcaaaaaatgagaaacgttggtgaggctgcagaggaaagcagacacttgtacactgttggtgaaggtgtaaattaatttagcgtaggcacagtcagtttggagatttctcagagaactaagagtggaactaccattagacccagcaatctgatggctggatatacggccaaaggaaaataaatcattctgccaaaagaacatatgtacctgtatgttcattgtggcaccattcacaatagcaaaaacattgaatcaactcatgtgcccatcagtggcggactaga

SEQ ID NO: 264917 - DNA, 201 bp, Homo sapiens
accagaccagggggcacagacggaagagaccagggtgtggtggcacgcacctgtgtcccagctactcaaaagactgaggtggggggatcacttgagtttaggagattgaggctgcagtgagctgtgatcgcgccactgtactccagcctgggggatgacagagtgagaccctgtctcaaaaaaaaaaaaaatagaagagca

SEQ ID NO: 264918 - DNA, 448 bp, Homo sapiens
gagcaggacgcagctggaaagcgaagggctgagcccgggctcagggcgcacagcgattccgcctccccagggacacgtcgcaagctgctggccccggcggccgaagccagtcctgcgtgggatagcaggggccggggaggcgacaggggctgcactacgagttccgcaggccgggagtcagcatggtgcgcggggcgagttggcgagggcccgcgggaggcgccggcagaggcagttgctggggctgtcgctgccgcccttcgcccggctcatagcgctccccgcgcgaggggcgcgccaaccccccggccacctccctccccactcctcaagggagccatagcgcccggggctgccaactccagcgccgcacagagtcccaacctgtggcgatcgccgggtcccgagaggagccggaggaaaagaatttgttccccacgtgcgagta

SEQ ID NO: 264919 - DNA, 732 bp, Homo sapiens
ctgccattttgtttcgttgaggtggtgttgtttttaggagggggtgttgtttgtttgtttgtttgttttgagacaggatgtcactcagtcacccaggctagagggcagtgacatgatcacagcttattgcagccttgaccttctgggcttgagtgatccttccaccttagcctcccaagtagctgggactacaggtgcacaccaccatgccctccctaatttttttatttttgtagagacggggtctcaccatgttgcccaggctggtctcaaactcctgggcttaagtgatcctcccatctcaccctcccaaactgctgggattacaggtgtgagccaccgcactcggcttatctgccattttgatcatgtgacatgtatgttaccatgattccttactgcatctgcccactctgcattccatcctgcacatgtagtgatgctcacctacctcatgaattatgcatgtcatcctcgttaagacaccgtgatgcagtctcctcagggactcagccagagaaccctttttcctgtgctgtttcccttatgcccaacatttctgggcataaatcttaataaaacttaatctcagaaaagtttgtctggcctgatattaatttctattacattgagagctgaaaatgtcataccaataacatatttcttggcaaccatgaaggggttgtgaggatttttgtacttattctggggggttgagagctagcaggactg

SEQ ID NO: 264920 - DNA, 289 bp, Homo sapiens
aggaaagctgtggagtcacttgtttttttaagattttataaaatatctacatgacttaagaaagctatagacctagacctagagacacccccatgtgattttcgaggagaatgtttcctctgaaaggtagacattgtcatgctctggaatttgtctttttggtagagacagggtcttgctgtgttgcccaggctggtcttgaactcctagcctcaatcaatcctcccaccttggtgtcccaaagtgctgagattaaaggtgtgagccactgcaccaagcctgggaattt

SEQ ID NO: 264921 - DNA, 534 bp, Homo sapiens
actccccgcctgttgctctttcccccaccatgttgtagctccttagtgtgggtctcctcccacctcacttcgcatgggaacccttctgcaagtggcttcacttacacctgtgtcttgttctgtctgggctgctgtaacaaaatatctgaggctgggtaatttataaaccacagagagttatggaggctggaagtccaagaccaaggcacaggcaggtttgatgtctgctgaggccttgaccactgcatcacatggtggaaggcagacgggcagaaagaggacaaacactgtgtcctcacagcagaagagaatgaacctcctccctcgagccctttgataagggccctaaccccatctggaagggctctacctgatgacttaatcacctcctaaaggccctgcctcttaaaactatctcatggggattatgtttcaatatataaattttgtgagacacattcagaccatagcaacctactatgttctttttccttatctgtaatgactggttatgcttataaatgtttgaaagca

SEQ ID NO: 264922 - DNA, 507 bp, Homo sapiens
cacgaggggtatgcacaaatctgtctctgtcccagtgttcccagtgacagtgaatgccccattatccactcagtctcccagatcaggaatctgggagtcatccttggttctactccccttctctttacccctcttcacttccagttaatcaccaagtcctattaactcctacctgtatcttctccagcctcattgccactggcttagttcagacttagcatctcctctctgagctccctggctcagccattcctcttgcagtgcctcatcttcccaaaatgcaaacgggatcacattcaatctgctaaaaaatctgcagtctagccggggatggtggctcatgcctacaatcccagcactttgggaggctgaggcaaaaggattacttgaggccatgagtttcgagatcaggctgggcaacagagtgagaccctgcttctaaaaaaaacaaaactgcaatttgatctctcagcatgattccacgtttaagcttctgagcacagcaca

SEQ ID NO: 264923 - DNA, 424 bp, Homo sapiens
cagatagaaggaaaaatgtttcctccattgttgctgacgtagataaagaatattcccttcaatatgctaacccctaggtggcttttcattcagaaggttcctaataatttgatctttaccctgaaatcaaacacatggaaaagagatggaagaatgtcctggagggattaagtgaagaaacagaccaggattcatttatgaaatatcctcagtgttatttcaattcagctccattcacattttattcttttgtgtctctgcactaatgccctccatattctccattctcctgccttagctagcaccttctcgatcttccctctacaaaactccttcagttcacattgcatttgtgctctatcctgggatatgtgttttctttcccatttcctcagttgctatgtattaaaaattaggactttta

SEQ ID NO: 264924 - DNA, 492 bp, Homo sapiens
taagtagaatgagcagaatgtttaatatttatagagcgctattaccagtggtagatttattacttgttaacaagtaatgagtcagtttttaatagtatatcatatttcttaactattagaaataaattttatcattgtgttgctttgtactttattttgttcttcgcccagtctctgtatttctgcaaatgtgagggggaaaggggcgaatctcattagtgagattctatggtagtaactatgctcatagtgttagtgcttcaggaaggttgttatttccacgtatctcattccagatatagctgctataacacaccctagagggttacttttggaacttacttttacaaaggtttttcgtgatgttcctgggtcctgttatgaaaaagtagtgcttacctgaaattcatattagcttcggtggcaatattttgtcgtgttaatgttatattggcattaaataccctcctttagccagcttagaataaaact

SEQ ID NO: 264925 - DNA, 437 bp, Homo sapiens
gatttacatcctgccaacatgttgagagttcccagtacgttacatctttaacgtgtggtattttcagactttacaattttcacaaacgtgattggtaggtagtggtatttcactgtggtttttaaattaaaaaaattttatgcattacattcgtacatatttatgaggtacatgtggaatgttgtgacatgcatagaatgtgtaatgatcaaattggggtatttagggtaactgtcacctgagtatttatcatttctatgtgttaagtgcatcacctgtatttccttctgtgtaatgaggttgaccccctttcacgtgtttattgtttgtctggattttgtctttggtgaagaacttattcaagttttactcacttttgtaatggattgcttgtctttattttattgctttataaaagtttttattgaaatctggat

SEQ ID NO: 264926 - DNA, 443 bp, Homo sapiens
aaatatcacgtgttcttactcatatgtgggagctaaaaatattgatttcatggaggtagagagtagaatggtggttaccagagctgggaagggtagaggggagaggaggatgaagagaggttggttaatgggtacaaacatacagttagatgaaaggaataagttctagcgtttgatagcacagtagaatgattatagttaacggcaatttattataaatttcaaaatagttagaagagaagatttgaaatgttcccaacacaaagaaatgataactgtttggggtgatggatatgctaattaccctgatttgatcatggtatgcatgatattttgataaatgcaaatatatacgtttatcagaatattacatgcaccccataaatatgtataattaatatgtcaatagaaaaataaaaaatacgaaagacagtaaaaaaaaa

SEQ ID NO: 264927 - DNA, 509 bp, Homo sapiens
gtttattgaggatcgactatataatagttaaatgtcagtgatagattgatttttgacattctgaaatttggataaaattaggaacttatagacttaaagtgggattcagcatgtatttaaagtgcaggatgttttggtgctgattctaagctagtgtttgataataaaatgtttgtgccatggccagtaggtataactaacagatgatatagcttgtaattttgattacactgaactctagtattgattttattgtaatgtaggctatcttagattttatctctttcatggatgtaactatatttgttttgccttcagagcgtttcctaggtggatgattaaagtagtgtgatagatttcggacgggttaccatctttttacatagtgggatttagaggttttgagttgttcttaagaatcaggccaggtgcggtggctcatgcctgtaatcccagcactttgggaggctgaagcaggaggatctcttgagcctaggagtctgctttgg

SEQ ID NO: 264928 - DNA, 310 bp, Homo sapiens
cgctgacgtctgagctaactcagaagtgatgggccagcctctcaagtagtcgaggaggtaagggtgatggagagcaggccaggtgaggaagcagcatgtaccagggcacgcagctatgagacagcaagggttctgtgcctgtcctcgggtgtgcggcgggtgagggtgaggcaggagtgctgggcaagtccgtcaggccagcatggttggcagttattccccaagctgtgtttccaaatatcagccactcaaggacggcctttatggtttatgttactatagtacgtagaaaagcagttcctctaactgt

SEQ ID NO: 264929 - DNA, 307 bp, Homo sapiens
gtgctaagacacacatcaagtatcactcatttaaaaataaaaggcttgttgttcaggagcatttgtgttggttgtgttgctattttattttctaattttcatctccctggagtcaaagtacacagcatcatgcttccataaaaacagtaattaaagcttttaaaatatacatattagcagatcacacactcctatcagtttatcttgtgaatatcataaataccatgcacacaacagatagaaattgcataaacagaaaaattctgcattattcatgaactgtagtttgcttttcccttggctccat

SEQ ID NO: 264930 - DNA, 444 bp, Homo sapiens
gctcctcagtggctctccccagagccacttcctttcctggcggattaaaaacaattctcattcagtatctcgctgtcatcagattttcccatattctgactttcctgggagcattttcacatattatcttagtggctctgttgccctctgattccaacctccctctgttcttttctggaggtagaagtcctgaaacagaaacgcttatccccagtcccaacaattaatccccaaagaaccttcgagacagggcaggttcatggctgcctcgtccacaaaagccctgttttctgggttccttgtcttgggcaacctgcagagtcagagccatcattgaaggatgatttgggcttcagctggaacaaggagaaatactcctgagccatctcctaatggttttctcggtcagggtctggattaagaagacatggcatcttgtagctg

SEQ ID NO: 264931 - DNA, 688 bp, Homo sapiens
ggcagagagagacagagagaaggaaagagagagacagtcagagaaagacagagacggagagagagaaacagaaagagagagagagacagagacagagagaaacatacaacagggatagcaatgacaggtacagggatagcaatgacaaggttcataatatgaccaaggaagcaaaggacaaaacacattgaatagatgagaccacgtaagagagagactagagtgcctgaataactaaaaatagtggcaggaatagtaatggaagagagacagagatacaaacttgcttcaagggatgaggattagggactcagaacttttggtggctgaaagaaggacaggtagcaggaagcttagtttgatggcatgacttcaaaggagttgaagactttaaataggaatagttgtctggagcaacaaggagcccagctacccaacactggcatgtggagtgacagcaaaattctagctaccacttgagtgtcttcagaggagatccaaattccagtcagaggaagaagaaggaaaggttcagagaggaggttgaagactttgatgactctgtgttccagcagggctggagaaaggtttgggagccagaattcacagccatatatgtagtggagatagctttgtttcccctgtggtccatcgtactccctgttatttagtgttcctgtctcctgaa

SEQ ID NO: 264932 - DNA, 421 bp, Homo sapiens
caaatttttttttttttaaattggaatcatcctgaacatctattgtttggcccgccttttcaaatgatttgaatgcttttctacaccacaaaatataattttcaaatgtgttgtctttcaaatgtgatttgtatgtggatgcataatgtttccttatatggatgtcactgtcatttatttgagcaatgtttatgcctagaaatgagacttgttggcaatgtgtatatagttggagcaaaatgtctgagtactttgaaaaatggtgtcagagcccaaatgacttggacatctccactctgagccaactggctcagtgttagtcacaactggaaaagggagatggagagaatgcctcacagactcatgaatgtgtttgtatgatgttattaacagagtaaattataaaatccagactacaaaa

SEQ ID NO: 264933 - DNA, 262 bp, Homo sapiens
ctgtttctgggagacatgggatgcctttgtaagttaactttggctcgatggctttggcaaacctccttatactgcagagcagtttaggatgctttaaccagccttctcttcatcttcacccttttgcaccacagtctgacagccttcccagccttctcttgctccttctctatttccttttacacaatcatttcctcaagtaaaatccttttgcatttcatccagtctgggcgacagagtgagactccgtctcaaaaaaaaa

SEQ ID NO: 264934 - DNA, 687 bp, Homo sapiens
tgtgtaagtcagaaacgtgggtttaaatttgtgtcctccttcttcatcacccctcacattccaacattcatcaagccccctacatatgtatatatgtacacacacacacacacacacacacacacacatatttttcagatttatactatatctttccttcccaattgccacttccatagaaagcagctcttctatctatcgtgaatcaagaccagagccctttaattggtctgcctactatcttactctcttctatttaccttctactatcctatatctacaagcagcagtgccactattttcctctccattatcatctgttggctacaccatccattgtgtacattaaactccagaaatgctgaatttttctcagtttctcaatacactggactctctattttgccttgaggacttgtgatagctattctctcctatgcaaatattcctcagacctacccccattcccctattttacttcacttctgcctagatgtcaacttttaggctagatgtcacttctagttagtgtttatggtcccacaggagcctctcaaatgctcacctagtatttttcccttctccagtatggccaaattgtaattttcttttggaagtgcctgttcaagtattttattcattttttattttacattgtctattttacatggatgtataggagagttt

SEQ ID NO: 264935 - DNA, 1392 bp, Homo sapiens
ggatacagtgagatttgtgttcggaaatgtcactgatagtctgtgaaggatggatcgaaggaggcatacattaggagaatgttgtctggtagtggaggaagatagtccttaaaataaggaagtggcagtaggtaggaagacaagggaataaatattcagaggtaggattgacaagacttaggggcagtctggatgtgtgaggaggaggaggaagagaactcacatagctcttggatctctgccctgagtgatcagtgaacagcggtgccatttacagaaatgaaggtggcaggaaaattggtgtgtgtgaaggcacttgtatgtatgtgtgtgtgcacatgtgcatgtatgtagttacctggccctgcatacaccatcacaggacagctgaactctctacttggccattagcagcccttgatgttgtgattatgttgttagtattgactgctctttcaggaccagccaacaggctcttgtggcaaactttatttttagtaccagacatcttgtattactgtaaatgagagcgagaggctgtaatgatagctctcaagcccaagcacctctgcatttagtggctctaatttcattatagagaaattaccatgaaatagcactgtgaccaattagatacacttctgggaaattttaggtgtaggtgaagcaccttttttcattcattctctgtttctgatagtttggacccagaatcaagctgacagtttatcgtgtagagtagcagcctcctgaggtcagcgcctcatgcattgtctggtgcatgagcatttcatgatgcttcccagagtgagttcttccaactctagccttcctactccttcttggagattcccagtacagccagaggccctgggaagtcttgctgtaaagtcagctgtttaactgcttaacccagcatctcccaaacttatttgaccaaagaacccccttttcacgggacactgttactaatccattaagctagtgttctgtggagcacactttgggaaatgctgaattggagcccaaatattacattcagtgcagagagaatctgctcggagatgtggactccagtgctttattttgccctcattacaaatattgatactttaaatgtttgctgaaacaggctgctttgactcttggtgactcgatacttatttatggtgctcagccagttatgcccacgtacagcaggtgggcagcccacaaataaacttagtccgtctgtttcccgagacacagaatgcttccccttatcttccagcattagcctggccctgaagcccctctttcgagggtctctgcctctcaagctccaggccaacaccagcataaaggacccctctctgaaggaagggaaggaggctcagctggaaataacaaaat

SEQ ID NO: 264936 - DNA, 372 bp, Homo sapiens
cccaggagagggggctggaagagagcgagctgccattgtattttggttgctgtggatctaaggagaagagatgtttaggagtctttccctggcatggttcctcctgccttcacccatcactcttttcctcgagggattccctgtggggtgcacagccccagggtgggccagactgagctcacaggagcatgggctgtgtttcagatgtggcctcagaatccttctcaacacagtgtactagcaccacttggtgctcctgatctactgtatcatctcttgaaaaactactaacatgaaaagacctgccaagtcaactttatattaactgaacccttgacacagtgatggataaaaattaattcaaacagcaaa

SEQ ID NO: 264937 - DNA, 467 bp, Homo sapiens
aggaaaagaaaaaagtacatccaatttatacacattagatctaaagactgggggccaaatcctaaaggagtgttaggttctcttcatttaggcctattatcacgttacaaagtacacaactgcactgctcctaaaggtcagtctttatactaggttatgcttcaatttactaaagccaactcgtgactccaagcaaatattctgttttggagtattgttttacctttttgctttccttttaaattaggcagcactcagattttaaaagagaaaataaagggaagaaaaagcctcaaccaggtctttaatgtgcaagatcaggtaagaccaaaagcactttactaatgcacatttgattatcaactgtacctttaaaatatgatcaggctgagaattaatatctgaattgttggcattccttaaggaaaacatcccagtacgaaatgcattcactttagaggtaaaaa

SEQ ID NO: 264938 - DNA, 520 bp, Homo sapiens
ctgactcattgtgcaacctgtggtttatgggcagggtcacttaactaaatgtctagccctcaatgtgcccatctgcaaaataggcagccgtgttctgctccttccccacccaccacaccaggggcagaattttaatctctacccttccactgactagccagtggagccagggacccgccctcctcaagccccagcgtcctcccctgtgcaatgtaacgttcccagtaatggagcaggtgtgcggggcagccccactcccctgaaggacaacagcaggccactggggaaaggtgaggtgtcaggaagtagcagagacgtgagccccagcatctcatttttggtgagctttccttcccccagagctctcttcttcccccttctcttttttttccctttccctggggctgggaaaagatttgggaagacaaatgtgttccacggggtgtgggtgggggaccctcacgcctcccctggctgaggtggaaagacatctctgaggtctggaagtcagtcacaggac

SEQ ID NO: 264939 - DNA, 452 bp, Homo sapiens
cttaggcagagaacaaagattggtggcttcctcctgagcacactgggatgtggcattacatcggggctgctgagtgcccttaccttcagctgcccagatgcagaggcagttccacaaggtactggcacaagaagagtcgtggaagactgacctggccatggcttctcatgtcccagctcaggacctgccacatcaattctccctttcctctggccgtcacgtgtggagtgaaattctcagaagcggctgtccctgtgcacctctctggctgtgtccagaaaatgaacatctgtttacagcttcaattttctaatgattagaatgccacaaacaagaaaacccagaggaaagctgttgatgctgaaatgtttccttcctctacatattccatgatgcgtcctgtggggttatgcaaacagtaatatctcattaaatattctggtctcttggga

SEQ ID NO: 264940 - DNA, 411 bp, Homo sapiens
ctagaatataaagctacatagaagttatcctgggaagaagatgggcatacccagatggttctctcaccaagagggtcccaggagtgacaacaggatgagaaagtaatcaaggcagaagccaccctgacgtgtgttggggactcaagaggcctaatattactgggaggtggcaggtagaaactgagaggtagggtgtgaggatgaggaagactgtcagcattgcagagggcttggacattaacctcaggagccgtggaccagcagatccagtctgtatgccatgggcacaagagcaacagagctgctgccagcactatcaccccacgccatatcttcaaacacacaggaaccatgattctgttcctcacagactctctcataatgaataaaaattttatttcaatgcactac

SEQ ID NO: 264941 - DNA, 280 bp, Homo sapiens
catctagaggatagaggccagggatgcctcttaacattctataatgcacaggacagcccctcacaacaaggaattatctggctacaaatgtcaatactgccactgttgagaaaccctgcaaaaaggaagcaatggatattttgagttattttcaataacttttaaaagcttaataaaatgtgtacttatctaaaatcacaacatacaagctaaataaaatttaaattatctttgtttttggttgatttcaaaataaattggtttagtgttgcctcttatt

SEQ ID NO: 264942 - DNA, 352 bp, Homo sapiens
gcactttctcaggactccttgagagtgggtttcctggcctgcagtcactcgtatcagtcagagtcaacttctttaaaatactttacagagtttggtttttctgtcaacattgcttagaagatatttcttattgtggttgaggaaaagtctgaaagccactgccctagcctatggctcttgcctataatcccagctaactgggaggctgaggtgggaggttcgcttcagcccaggaatttgaggccagcctgggcaatataacgaaaccctgtctctaaataaaaataaaaaacaacttatacagtttgttctcaactaccacccctgcaaaaaataaaaaatcagttttact

SEQ ID NO: 264943 - DNA, 413 bp, Homo sapiens
gcagacttgcccaaccccggcctacagagaaaccacaatccccatttttcaaaaacatctaattgtacaatgtattttagtgcagggtctggttgggcaagataaacatcgcctcctgattgtagtttcacaaaggatgactaacttggcctgaattcctctggctcccaagatatttcgacaaaaccatcaaaggatctattttctacaactgtacaccagaactcgggtaaacactgcgagagtacagcagtagcaagagagaattgggaaacagtcgccgagtgaaacgaggcaatttatcgcccacttccattctcactctctcacaaggaacctttaccagtttgggagcctgtttttaagggagggggagggaaacggatctgtacggagtaaatcctgtttcgcca

SEQ ID NO: 264944 - DNA, 746 bp, Homo sapiens
gggcaccgctgagccccaggcagggcaaggacaggggagcagtgtgtttatgtgggggaaaggtgacatgcctttcatcacccatcatcgggctcacgaccgacactcttgcaacaagacaggtcagcaagagaaaagcatcacaaagttattgaatcaaagttttatgtgacatgtagctttcaggaatgaagaccgaaagaccccaggaaatggtctgtctggtgtttaggtttgatggagcagggatagctgcgtaaaaatgggattgggatgaaagggtgtgatctactgagctagacggaggcggggtcccagcaaggcctgcttgctcccattcctcttggcctctgcatggtgttccttcctcccagtgtagggcaggacctctctggaacttacaacctgcctccctcagacaaggtaggttggagaatttctctgtggatggctcctacccaggaaggtaggggaaggttagagttatatttctaggttttatggctggctttcagggagaggggttctagattctatgacccaccttgaggaagaattctggttccgtttttcttttatctttttttttttttttttgttaggagggatggggatttgctatgttgcccaggctggcctcaaactcctggccctaagtgatcctgctgcctcggcctcccagtgttgggattacaggcgtgagccactgtgcccagccgcctagtttctatgactcacttcagggg

SEQ ID NO: 264945 - DNA, 124 bp, Homo sapiens
ggaagtgaaagacatacttagagaaatacaaaatacactggcaagtttcaacaatagactagaacaagtagaagaatgaactacagaactcgaagacaaggctctggaattaacccaatccaac

SEQ ID NO: 264946 - DNA, 382 bp, Homo sapiens
tttttttttttgagatggagtctcgctctgtcgcccaggctggagtgcaatggcgccatctcagctcactgcaacctccacctcccaggttcaagtgattctcttgcctcagcctcccaagtagctgggattacaggtgcatgccactatgcctgactaatttttgtatttttagtagagacggggtttcaccatgttggccaggatggtctcgatctcttgacctcgtgatctgcccacctcggcctcccaaagtgctgggattacaggcgtgagccatcatgcccagcctatgcagttacatattaagccttttccacactgaagacagatgtgaggcaccagagatagatccactaggatccccagaaatttattctgg

SEQ ID NO: 264947 - DNA, 4408 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccagggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264948 - DNA, 4255 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccagggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264949 - DNA, 411 bp, Homo sapiens
actacagcgatcccccctggctgctcaggtctcgaggaggcgtgtgctgcagctacgggccctggggagagtttcgtgaaggctggcacgtgcagcgtccttggcagttgggtgcgtgagtccgtgatctcaaccccaccttcccggccaagtaggggaccctcagcatgaagcctctcgtcctcattccttcccagacccttcccctctctgggcctccacttcctgatcgggtaacgttaggaagcttccaacatccccaccagcggacattcggggatgtatgagctgagagcctctttcctcatctctatacctggctccacatccccaggccagagtggggccatttctccaggcaagaagagagcgcctaggctgaccccgtccctgtagacccagatgagcagg

SEQ ID NO: 264950 - DNA, 7386 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264951 - DNA, 7230 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264952 - DNA, 7226 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264953 - DNA, 7578 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264954 - DNA, 7627 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
  misc_feature (4179)..(4179): n is a, c, g, or t
  misc_feature (4333)..(4333): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctntcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagacncacgcctgttctcaagaagctgcagattaggcatggggaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264955 - DNA, 7489 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264956 - DNA, 7474 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264957 - DNA, 7413 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264958 - DNA, 7342 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264959 - DNA, 7310 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264960 - DNA, 7358 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264961 - DNA, 6989 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264962 - DNA, 7202 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264963 - DNA, 7154 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264964 - DNA, 7141 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaagccggtgctcatgggcttctctaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264965 - DNA, 7126 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264966 - DNA, 7018 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264967 - DNA, 7261 bp, Homo sapiens
  misc_feature (1)..(1): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggttactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264968 - DNA, 6910 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264969 - DNA, 7439 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
  misc_feature (4179)..(4179): n is a, c, g, or t
  misc_feature (4333)..(4333): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctntcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagacncacgcctgttctcaagaagctgcagattaggcatggggaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaagggcgagccagtggtcttcccattccacgacgattgctacaatacagacggccacgtgaccaagcatt

SEQ ID NO: 264970 - DNA, 6924 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
  misc_feature (4179)..(4179): n is a, c, g, or t
  misc_feature (4333)..(4333): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctntcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagacncacgcctgttctcaagaagctgcagattaggcatggggaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatgattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264971 - DNA, 5559 bp, Homo sapiens
  misc_feature (1)..(1): n is a, c, g, or t
  misc_feature (3415)..(3416): n is a, c, g, or t
  misc_feature (3418)..(3418): n is a, c, g, or t
  misc_feature (3426)..(3426): n is a, c, g, or t
  misc_feature (3442)..(3442): n is a, c, g, or t
  misc_feature (3455)..(3455): n is a, c, g, or t
  misc_feature (3465)..(3465): n is a, c, g, or t
  misc_feature (3477)..(3477): n is a, c, g, or t
  misc_feature (3495)..(3495): n is a, c, g, or t
  misc_feature (3511)..(3512): n is a, c, g, or t
  misc_feature (3514)..(3514): n is a, c, g, or t
  misc_feature (3524)..(3524): n is a, c, g, or t
  misc_feature (3535)..(3535): n is a, c, g, or t
  misc_feature (3562)..(3562): n is a, c, g, or t
  misc_feature (3572)..(3572): n is a, c, g, or t
  misc_feature (3582)..(3582): n is a, c, g, or t
  misc_feature (3585)..(3585): n is a, c, g, or t
  misc_feature (4179)..(4179): n is a, c, g, or t
  misc_feature (4333)..(4333): n is a, c, g, or t
ntacagccccaaggtcgctccctctgggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccgggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaagggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctatagtgtgattcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcgagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccgggaatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaggaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcaccnncncttcctcngcatccacaggtcacnccacccctcttcntgtcaccgangcttcctcagtntccacaggtcacgccacncctcttcctgtcaccnncncttcctcagnatccacaggtnacaccacccctcttcctgtcaccgacncttcctcagnatccacaggncangccacccctcttcctgtcaccagcacctcctcagcctccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctntcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagacncacgcctgttctcaagaagctgcagattaggcatggggaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctttttcgaaaacagcccactgatgtcccagccagtgtgggagaggtatcgccctgatagattcctgaattccaactcaggcctccaagggctgcagttctacgggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcccagctctctccgttgtaaaccgaatccgtagcgagcggcgcg

SEQ ID NO: 264972 - DNA, 2145 bp, Homo sapiens
tgagctcggcccgagtgatatgatgacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264973 - DNA, 449 bp, Homo sapiens
gttgtcgggcaggttctattctgatcagtgagcttgttgagggagtgttgctagtactcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaa

SEQ ID NO: 264974 - DNA, 449 bp, Homo sapiens
ataaattatttggaattcttctgcaggagatatttgttctctgccattgttaattaattaattagttaatttttatcagtgtagagtcatggatatttgttttatagtttggattataatccaaaactgtttattttgttgctcaaatttctcagatttgccttttgggagctgtttcaattggctcctgtgactctttcacataccctcattcaatgatgactcttgggagagcaatttcaccagagtggtaaacacagcataacagtacgttgagaagtaaataagtgttgaagaagtggaagcacaaaggcagttaagtagcaccttaaatcagggtgaggcttaatatttgtctttataagtccttaagacattttaatctcataaaacacaggtagatgaaagccctgcctatgccatgaaaagccctgaagcattaaaagaaa

SEQ ID NO: 264975 - DNA, 200 bp, Homo sapiens
tgtccccacacaatggagcattggaaagaagaatcagagagaacgtgctgttcccggagcccatcagcctggccaaaccctttcagggccaaaaggacctgtggaggtcagaagggaaactgaggccgggtgaggggctcccccttacacaggaggtggggtcagacctgagacagggcctacacctgccaagccctggg

SEQ ID NO: 264976 - DNA, 309 bp, Homo sapiens
tgttcagctttactctcttaatgttcagatgcacttgactgctacagccaggcaactctcagtattgtctctcttgtctccaaatagtgggtaaaagcttgacctcaaacatttgtgttggaagggttagaccgcagaggttgtttggtcctaagctccttaaactgcgatgtgtacactgagcatcctctaattcttacagtaaatgtgttgcattaacctttgaacttggaagaagaaagctttggccagttagtctttcttttttttttttttttttttcacattaaaaaaatagacttatcagaa

SEQ ID NO: 264977 - DNA, 299 bp, Homo sapiens
ttatatatgattttacttaaataagtaaatgaatataaaaagcgagaaaattttatgacatagttatggcaaattaacatttattggttgaaatactacctcttaatgcagtttttcaaactgggtattgtcactcattagtgggtagacaatttaatgggtcatgattagtatttaaaaaattctgagtagaatagaaaatatcagtgtattgcacatagtaaagttattttgtgaaacctttgtttgacttgcattgagttgaaaataatgtgtaatgggttataatgtaaatatgt

SEQ ID NO: 264978 - DNA, 536 bp, Homo sapiens
tccatactctttgggttaatacatcacttgcttttataatagtctgaggtctatttcaaatggatttttaaaatgtcttcagtcagtcactgctgtggtttgaatgtgtcccctccaaaattcaggtgttgccaatgtgaagataatgagaggtgggacctttaggaggtgattaggccatgaggactcctccatccttcatgggattaaggcccttataaaagagcctccacagcttgggcacggtggctcatgtttatagtcccagcactttgggaggccaaggcgggtggattgcttgaggtcaggagtttgagaccagcctggccaacatggtgaaaccacgtctcacgtctaaaatacaaaaattagctgagcatggtgtcatgcacctgtaatcccagctaccagggaggctgaggcaggagaattgcttgaacccgggaggcggaggttgcagcgagctgagacggcatcactgcactccagtctgggcaacaagcgagactggtgataagcgagactccgtctcaaaa

SEQ ID NO: 264979 - DNA, 251 bp, Homo sapiens
ctagttactagtgatatagtgggcaactatgttctggttctcaagaatattcatagtcaataataagcataacatagtgataatatgatacttagggagatacataaggtcatattctggcatactctggagagagataccgtaatcagccttgaggtgcaggatgtgatctgtaaactgagacctgaagtatagttagactggtaagaggaatgaggatatatatggtggttaataaaagaacattctgg

SEQ ID NO: 264980 - DNA, 694 bp, Homo sapiens
gccatcatcttccatagcggaaagtcaatgtacaatatcccaagtaaaaaaatcaggaggaacacttgacattaaggtgtcaggaagtaaataccaggcaaagagtggaaagtggtttgaggaaggtggattggaagtaggctggctggctgaggactgctcttttccttaaggaaccttatgaaatctgcaggctctttatattctagtatataactttgataaaatttaaaaaatgatttaaagtgtaatagtataaatagagctaaaaagtaaagactttatcaaaatagaatctatgtgattttggtaaacaattttgggggtactccctttcccttttgataaatagaattgtactaatttctaatgtcccttgaactctacatttgtttattgtatttctttgtacatgtgtctgtacttttgaacacaaacacacagaaatctggtaactgggagtagagtcccctgattattttgatcattaaaatttggtatgtattatacacacacatgcaaaaacacaatctgatcccatcaaatgaaggtggcaaagccatcttctgatttttagagaaacaaaggaggctgcatttctatcttcctctgtccaggtgagaggagaagccgggagagaccaaagtacccttctgtttagactcttgtgtgtgacgtatggtgatgctgacct

SEQ ID NO: 264981 - DNA, 517 bp, Homo sapiens
gttgcagtgagccaagatgggggcaataagagcaaaactttgtctcaaaaaaaaataaataaataaaaaataaaatatgtcaagccccttctcttcctgtctcctctcgtggtgtgtacttgactccccttctcgccagatctcacaggactttcagatttaagcaatacctggccaagaaacaaaagcaaaatcattccattcccccagtggattcagatcaaaactggtaataaaatcaggtacgactccaaaaggagacattggagaagaacgaagcggggtctataaggaattgcacgtgagatggcacacatatttatgctgtgtgagcattacaatcgcgttaccatatcaagctgaaaatgtcaccactatctggagtgttggaaatgttttattgggaatatgttttttctctgaatctgctatgaacacgtcagttgggtgggttcagtaataaatatgtgagacttttcatttcaaaataaaaaaggcaaatgatgtaaaacataga

SEQ ID NO: 264982 - DNA, 1390 bp, Homo sapiens
cacgaggagagccaggaacaggccaggtcaggggagctggagcctggctaggtatggagagagcagggtacacttgctgcaactgtgagaagagccaggggtggccctggtggcctgggcgcgtttagctgtgcctggggccaggcctgactggctgcaagtcattactataggcggagagtgcagagtagcgcgctcctgctgtcactccctcctccaagtccacaaagaggcaagaaagggaggattttaaggcctatccataccgcatggcaggtgagagcagaggagcaaacagcacttttggatcctggaaagcagaaggtgagtgtcccaggcgtagctgacctgagaaaggcgactccaaagccagcagcagcaacagctggaactgccccagcctgcaccacgggacccccagctctgagactgagagcagctctggggacctctgggctggggtgaagagggatggctggaatcattgttgcaaacaattcagtaggcaggcagctccctagatcccaccgtggtctgcagaggccagcacctgtcccgacctcttactggtcggccctggagagccatctcctacagaggcaaaatgaacggtctctgggccaggaccaggcctgttcagggggatgtgtggctaagtgcataagggatgctgagactacagccctcgtgcccaggcagcgctcagggcatggatagccaggccctccccatccaggccagagatgggaagactccatccaatctcattccatgaccagggactggcaaagctctcagttctctctccatcccagcaggagacaaagaacccaacctcagagattcctcaactcggagacccagccaggccaccctccagagcatctcagtctgcaagccccttggtgtgctcagagcttccagtcacactgctcatgcctatccgtgcacagccagggattgcccttcgtggaggaaaacttcatgaaacaaaaaacaagctccgtggggaacacagaccatagaggaaaaagaaagctgtagaaaaagaaatgatgaatgccttcctggaggtgagaaagccatcgtgaaacgagaggaggttgctccaaaaagttcctagagagcaaaacaagggccttggaggcacaatgattgccaccgtggagacacatttcagcgccactagagtaaaaacactgcagacaggtgagctctcaacagatacatgtccctcgccttctcaggaaagatgggcagtaatgagggcagaagccacaaagaggaaaccgtagtgacaggacccagggtccttcaagctgcggtggggcaagcgctcgggacagtggtgagggagcagctcagccccaggtggtgcctggcaacccgc

SEQ ID NO: 264983 - DNA, 2900 bp, Homo sapiens
ggcaagaccttcagtcaaacgtcataccttgtgtaccatcgtagatttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcccttatttaccatcaagcaatccatggtatagggaaactttacagatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaggtgtaatgaatgtggcaagacctttagtcggaagtcataccttacatgccatcgtagacttcatactggagagaaaccttacaagtgtaatgagtgtggcaagaccttcggtcgaaattcagcccttataattcacaaggcaattcatactggagagaaaccttacaagtgtaatgagtgtggcaaggccttcagtcagaagtcatcccttacatgccatcttagacttcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgattgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtttttatgggtatctgttgaatctaaa

SEQ ID NO: 264984 - DNA, 3296 bp, Homo sapiens
ggcaagaccttcagtcaaacgtcataccttgtgtaccatcgtagatttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcccttatttaccatcaagcaatccatggtatagggaaactttacagatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaggtgtaatgaatgtggcaagacctttagtcggaagtcataccttacatgccatcgtagacttcatactggagagaaaccttacaagtgtaatgagtgtggcaagaccttcggtcgaaattcagcccttataattcacaaggcaattcatactggagagaaaccttacaagtgtaatgagtgtggcaaggccttcagtcagaagtcatcccttacatgccatcttagacttcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgattgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtttttatgggtatctgttgaatctaaaaaaaaaaaaaaaaaaaaaaaacctcagaggctctctttttcgggtgtgcgggaaaaacggggtattgcgaaatgggcccatgggtcataagctggttccctggacccaggttttcttggtccaagggggtaaatctggccgggtccccctatagggaggccgcaataacatctcgcggaataaaccccccgaggtttttacccaccgggggttttaatgaacttcccgggcgaaaaaaacgagcagacaagcaatgacgcaagaaagagcaaacaatggtgacaggtgaacatgaccacaagacgacaagacacgaggacacaacccacgcgaccagacgacacgacagaaaaccgacactgagcgagaacagacaaaactgcattcgcatcatac

SEQ ID NO: 264985 - DNA, 479 bp, Homo sapiens
agagagaaaaaaactcagagaagtcaatatttttaaagagcaagaaatgggataaaattcagcaaataattcaaggttgagctctatcacagtttagattataaatgccaacttctcagtcattaagtatatatgttaatattgtgtttctgtgtaatttttggaggattaaatatttaatatgttttatttcattttgatttgctgtttgttgtaggattactttcatcatttaaatgcttaattgcagataatactagaagtatatggaggtattttacttgtaaataggaaaatttgtaccataagttgttgggaagtttaaactcttctgtcacccacctataccagtaaagctccagtagcagcaaatgctttttaaaatgtctcttgagaagtgaggaataaacagctttccaacagagaacaggttttctctgcacaaagggtaaataggagaatttacttttgtaaataaa

SEQ ID NO: 264986 - DNA, 847 bp, Homo sapiens
ggagtgtagaaattgcctttcagtggaggttgtcaagacgactactgggaggggacacaggggattcaagtagtggactgggagtagacattggactagatgatttttaaggttgatttcaatctagcgactgtgatttttaggacatattacatctcccggaaaatgaaaaatgaagatacatctggcagttggggaatttcagattcattggttcagggtccctaaaggctttttctctccaacttcttcaagtcctcctgcaattatattctttctcttgcacatcaatttctttccagttatggaaacatccctatcaccatcagaacatgcctttttatcacccttcttaaaaaacaagttaaagaaatttctctattcaatgtagccttccagctctatggcacttctctcctgcccattctggcagaactgctagaagacttgtctcctggggtgtgtacaatctccccttcctgctgcctcctccccactccactactcctcaaaaaccctttctgttaaggtcaccaaagacctccattttaacaaatcccatggcctgttctagtcctcatctttttcagtctctcagtagtagttggcatcatccatcccggcccccttctttttctttttgtagtatgaccttgtaaccacccccaccccctcacttccctttgaagcactgtcctgacttgacttccagggcatcacatcccctttttttctcctacctgaataactgttctctccaagggcctctacagatggaattgccccagggcttagtccttgactttcttcttcatactacactgtctctagggttcttaacctgcta

SEQ ID NO: 264987 - DNA, 605 bp, Homo sapiens
ggactgtccagatgaacctgatgtttctgaggggctgctgtaaggctggttctgcaagagttagaaagactaacctggactcagctgctgctccggaaaagcactgcctctgaggggtaaagaagcattccaggaatgacgtatataggaaccacagcagacagaaagctcacaggagcgagcccctttccttcctccagcttccactcccctgtgacaccctgtgttcatggagctgcacaagaagccagccaacaaagcagacatttggtttgcagaatggcaaagccaagtacgcaaggcatggtttggaggctgagcatctacgactcactagctgggactctagcttccctaaggtcttgcatatctcactgggacatttcctggccaccctagttaatagtggctgatctggccctttctatctcttttcccattttattcttcttaacactgacctatctggcaagtagtagcagatgctttggttctgtatgtcacatccccttggcttagctctctctcaacaacagctgcggtggacggttctgtgagaactcggactcatgcccttcactgaggccctgttcttcaatcaacac

SEQ ID NO: 264988 - DNA, 568 bp, Homo sapiens
tcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagcttaaaaaatgtg

SEQ ID NO: 264989 - DNA, 446 bp, Homo sapiens
ttttgagcacctgctatgtgccaggagcattcaaggcgctggggattcagcagagatcaaaccagaccaaagctccagttctcggagctcagcttctcgtggggtgacagaggggcgcacgtggggagaactgtctcctctcctcttgcctggctctcactgctactacacatgggatttccaagtcagggctctttgcaggaattgcccagatggtctcttgcaggaagccagagagcctaagtgagattcgtttctgccccaattgataatttatgaaagcaacttcataaacaccaggtagtgtcccatttgttactcatttaagattattatttcctccattctttttatgaggggttttcttgttgattgtagcaagtggaagtaggtgtagggagataagttgttatggtgtcttcaaaaataaaaactaacaaataagc

SEQ ID NO: 264990 - DNA, 266 bp, Homo sapiens
acctgccttggcctcccaaagtgcagggattacaggtgtgagccaccgtgcccagctggtacctttttttttgttgttggtgaagtagaatgtgtgtatggggagggcaggtggataggatattttggaatttgaagagaatgggaatgtctggatagtgcatgtatagaatgggaagtaaacactggaggacctgggagtgtggtgcttattgatggatcgttgggtttatccaggattggggttttgccagatggctgtgatga

SEQ ID NO: 264991 - DNA, 308 bp, Homo sapiens
gctcgctggtgctttcctctctgctctggggtgtccctacttagttcttcttccggaagacctccagagcctggttagggttgtcgtgagtcctcggccactgcagaagctccccagcagtgatgagctgtgcccagcttgggggggggcaggtggataggatattttggaatttgaagagaatgggaatgtctggatagtgcatgtatagaatgggaagtaaacactggaggacctgggagtgtggtgcttattgatggatcgttgggtttatccaggattggggttttgccagatggctgtgatga

SEQ ID NO: 264992 - DNA, 222 bp, Homo sapiens
aaggatggttattaaaatgtttatgtttgagagaaacacagcttctcaaagatggcggggaagggtcctcacagttgtgccaagagcaaaaatctatacagcactcactatgtgccagtgaacagtcctaaacacttcatatatattaattcaatcttcctaacactgcagccctgttaggtaagcactactgctacccctattttagaggaagtaaacctg

SEQ ID NO: 264993 - DNA, 794 bp, Homo sapiens
taattttaaaattaggtgagggtagaatcatcacaggttaggaatacattcttcataagacacgatgctgtaaatacccttaatggacgaaaagttgaaatacttttgtttcctcttggagcagttcagggaaatgcccaccggggattgtcctgcacagatagggcaagaggatttcctgggtggagtctgccaaggcctgcctcgctggggaccccagagtcctgcacctctggttccgccccaggtggtgacattactgtccccgttctgtggctcgtggacaagactttctccagaccccttaaagtggtacatattctaaaaaactgtttttctattatgccataaccttgctctagtcagtgaatgttcctaatgctgctgtttcaacatttgaattctttttaatttatgaaacatgctaaattttttttttcaaacaaacacacacatccacatatacacatgcttcgctatgtggcttccaaggtttaaattttgaaaagtaaaagaattaaaacttcacgaccacagatcacctcaaaccagaaatacctcagaattttctacttatgtaaggtttattatatattttgttagttgtgttgtcttgtagtaagtatattttaatgtaagttggcttttgtgacaaggaagtttaaaagaaatagagaaaaagaaaaaagtttgcatcttctagggagtgctaccatttttgtttgataacgcccccttgtaaataattgtcatcaactgtaggttggctgtctgggccaagtctgggcatttat

SEQ ID NO: 264994 - DNA, 583 bp, Homo sapiens
tcacaaggtgatctttggccccatgttctgaaacctgttcagacatttgcaaaagcttcctctcttttccccaggagcaatttcttgcccagagttctcctgatcccaggtccttcaatctccataaatgaggcccaccccagatatttaggtcacttaattggccaaaatgccaataacacagtgtgtttagggacacagtctggctcaggacagaagataggactacatacaggtcaggaagtcttaatttggatcactgctgacttggataagaccctaggtagcaattagcaagttactttctgtcctcaacatgccttttgttcgacaagggcctggatatccaaattgttctggccagcggattggagacccctcctagtcgtgcctcttccttgctggcaaactgaagagtccttcccaagtgtccgtttcctcagctgtattttattttattttttttacttatttattttgagaccaagtcagtctctgtcacctaggctggagcttgcagtgagccgagtacttgtcgctgcactccagcctgggcaacagagcaagactccatctcaaaaaa

SEQ ID NO: 264995 - DNA, 311 bp, Homo sapiens
tgctgtaatatgatattaatgttactatcccagaccatactgtatttttcttgggcatccttatctgcataaacattctgagctgcctttttatctgacccagatggtctataataatttcctattagtcttagtttccttttatcttttatttccatccaaacatattttgtcccactgccaacttatttattatgtgacattctttctcccttcagacacaatatccgccttgacccatgttggcataattccccctagcctgttgtgtctatctcttgcataaactttccatatccaaattattccaa

SEQ ID NO: 264996 - DNA, 1030 bp, Homo sapiens
ataaggtattcccccatatgtatgtattacttcccctttgctgaaataagcgcaagaaataactaatggttttctccgctatagagacagagataggaaaggatacaaaaaagaccatggccataataaaaatcaggactacacagtcaccacaaattaccagaagatgagagagaaatactctgtcaactatactactgacatacactggaatgtcttcttagaagaaattttaaaggatttagtgaacaaccagttattatttcagaaaataaaaattaataaaaattttcagtgaaaggtagtatacaattggctattataattggctgtttagttctttgtaccctccacaaaattgcaagatattttttaactttttattttaaagtaattaaaatttcacaaaaaacatgcaaagaaatggacgggaaggtcatgtgcacccttcatccagtcctcattctcagtgttaacatcttgcaaaactgcaatattaaaaccaggaaactgacaatagtacaatccatggagcttttcatagaatccatagatatttcaccagctatacatacagttatttttgtttgtatgtgtgtatagctctatgtcattgtatcacatgtgtagcttcgagtaaccactagcacaatcaagacacttaactgtaccatcaccataagactccctagtgctaccactttatgcacaccccaccctctccccttcccctccctaacccctggctaccactaatctttctccataatgatcttatttcatgaaggttgtataaatgaaatcattcagtaatgtatctttttaagacaggtttttttttttcactcagcacaatttccttgaggttcatccaggttgttacccataataacagtttgttagtctttattgctgtagtctatagcatgcttatatcacagtctgtccaaccattcacccattgatgggcatatgggcatttccagtttggtgctattacaaataaagttgctgtgaacattcatgttca

SEQ ID NO: 264997 - DNA, 505 bp, Homo sapiens
caggcattgacttctcctcaatagctgtgaaagtcctaggtggcattttccaatataaggcagtttagtccacactgaaaattcattgtttagtgtagccaccttcatcaatgatcttagctagattttcttgataacttgttgcttctctatcagtatttgctgcttcaccttgtacttttatgttatggagagggcttcttttcttaaacctcatgaactaacttctagcttcaaacttttcttctgtggcttcatgaaggttgtataaatgaaatcattcagtaatgtatctttttaagacaggtttttttttttcactcagcacaatttccttgaggttcatccaggttgttacccataataacagtttgttagtctttattgctgtagtctatagcatgcttatatcacagtctgtccaaccattcacccattgatgggcatatgggcatttccagtttggtgctattacaaataaagttgctgtgaacattcatgttca

SEQ ID NO: 264998 - DNA, 425 bp, Homo sapiens
gcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattc

SEQ ID NO: 264999 - DNA, 416 bp, Homo sapiens
tcaggcctcccagatagtaccaaggaactgaaatttaccagatcactgcatctggataataagacaccagactcctcacccatcatgattgcctaattcatcacctgcttcctgttgaccaacttctcttgcttacccctccctaattcctgttttcccacatgtggttacatttcttccatgctgtataaacccctaatttcagttggttagggagatggatttgaggctgatctccttggcagcatcacctgattaatgccttttttcttggaaacactcattgtctcagttattggctttctgtgcagtgagcagcaggacctaaaccctggtgtcttggtaacagtggctgcaccattttatattttcactaatagagcacaaagatcacaatttttctacatcctctcaaa

SEQ ID NO: 265000 - DNA, 358 bp, Homo sapiens
gttatctgtaccatttatgaaatgcaacatagtgattctaatgtgtaattattctgttcattttatgtaatgacgatgacaagaatgcctctcaagtagtaatttcttagtctttttgcttacagataggtttgtaatgtttctgcatgtgatattttctacctgtatcctaagtagatttttctttagcatgtttgttacaatgtaacaactttgcattataagaaatcaaggcatttccaatatctttatgctacatctatactttgatccctcagcaagttgtcctcactgttgtgtgaacctgtttttctatatttgcatgccattaaattcttgatgaccttcagtaggcaat

SEQ ID NO: 265001 - DNA, 144 bp, Homo sapiens
ggctgcatttggcttctgtaatttgacgaagacactggccctcttggcatacaaaatggccaagcgaggattcagcttgatggcatctgtgaataagtcaatggctttctggagttcaccatcatttagggcttcaatagcagc

SEQ ID NO: 265002 - DNA, 403 bp, Homo sapiens
tctggagacagtctcactgtcacccaggctggagtgcagtggcgcgatctcggctcactccatctgcctccccagttcaaacaattctgctgcctcagcctcccgagtagctgggactacaggcgcacaccgccacgccaggctaattttttgtattttagtagagacggggtttcaccgtgttgcccaggctggtcttgaactcctgagctcaggcaatccaccctcctcagcctccctaagtgctaggattacaggtgcgagccaccgcgcccggccagagttcactcttaatattaatacaacgggagagagaagaggccaggtgtctgggacaaagctgatataaatttgtgagcaaaagcaaattaatgtatttctccatgtcaaatagcttaagtca

SEQ ID NO: 265003 - DNA, 405 bp, Homo sapiens
accattatcaagttaaaaagttattcaattaaatataaagttgaaaaagaactacctacacatgttgaagatcaggttttatattacttcatatataactgaagagctaaatagattttaaaaagaacaaattctaagcgttatatataactggtataagaaagacctgtgctggcctggcgtagtggctcacacctgtaatctcagcactctgggaggccagggcaggcagatcacttgaggtcaggagttcgtgaccagcctggctaacatggtgaaaccccatctctactaaaaatacaaaaattagccaggcatggtggcaagcgcctgtaattccagctactctggagtctggggcaggagaatcatttgaacacaggagatggatattgcagtgagctg

SEQ ID NO: 265004 - DNA, 438 bp, Homo sapiens
tgagatggagtctcactgtgacacccaggctggagtgcaatggcgctgtctcggctcactgcaacctcctcctcccgggttcaagcgattctccagcttcagcctcctgagcagctgggattacaggcgcccgccaccacgcccggctaatttttgtatttttagtagagacgggggtttcaccacattggtcaggctagtcttgaactcctgacctcaagtgatctgcccgcttcgacctcccaaagtgctgggattacaggcgtaagccatcgcaccccaccattctagtttttttttttggagacagggtctctgtcgcccaggctggaatggcagtgggcagtggcacaccctcctccactattgcctgtctggcccaaactagtgtcatctttcctctcagcaccacagcctcctctttggtcttcctgcttc

SEQ ID NO: 265005 - DNA, 775 bp, Homo sapiens
ctttgctcttggttataaggaaaggctgcctgtgggctcatagcactgagagcttcccagattgtagacattcccttggcacttagaattctagactggcagggaccctcaaggtttcccatccacacttctatttcatgggtgggaaactgacatccaggcagtagatcagggatgcctgactccactccccttatctcattctggcaattctaattctttaggcagatctctctgcctccagggcttaactctgagctgagaaagcctaaaacggagttctgtttatttctgcgcccctctcaagtaggtattaaaaaagattgaagacatgaaagaaagaataactgaatgttactgatgccagaagcaactctcgctgggcgcaactctcgctgggcgcaactctcgctgggcctcagtttctcatgagcagaactgcagggggtaggtggtcccagtctctagggtctccaccaagcttcttctcagtgcccaggaagtggtacagtgtgctctcaatagtccttcagcttatgacagcctcagctcatgggacttgatgacagggaagagcaagctgcatgccatgaagtcagccaggtttgcctgtggaggctgctcccatctcctttcagaactgccccctcccctatcaggcccccacttcttccccagggccttgctctcagccagctgtctgggatggctttcctgtatagctttgagctccttcagcacaggagcctgacatggagtaagaaaaaagaaagaa

SEQ ID NO: 265006 - DNA, 424 bp, Homo sapiens
aggctgttctcaaactcctggactcaagtgatcctcctgccttggcttcctaaagtgctgggaccacaggtgtaagcccccatacctggcagagttattcatttttaaagaatataaaagttggctgggtgcggtggctcacatctgtaatcccagcactttggaaggccgaggcaggaggattgcttgaggccagtagttcgagaacagcctggccaatatagtaagacaccatctctataaaacacacacaaaaaatataaaaatttaaggttacttggcttctcttgcaaaatgaagaactatgtaagagaaggattttaaaagtaccagtagttactaaggttatatgtagttttacaagcccccattcaaatggctcagataagtcaatttttgagaattttcatttgtttttgcttcc

SEQ ID NO: 265007 - DNA, 242 bp, Homo sapiens
tccgagaaagggtctccctctgtcacccaagctggagtatagcggcacagtcatgatactgcaaccgtgacctcccgggttcaacttatcctcccacctcagcctcccaagtagcttggaccacaggcaggcatcaccacaccctgctaattaatttaaaaaaaaattgtagagatggggtctcgctgtgttaccagggctctgtcttctttatagatggggaaagtgaggcccagaaaggt

SEQ ID NO: 265008 - DNA, 422 bp, Homo sapiens
tgaccaccagggattatttccgtgggttttaagggtgggcacatgattctacctgagccaaggacacttagtcccatgactctttggggctgctgggaagagattttgctccaccacagatgctcaaaggataggacatgctcttgcggctgctgggaagagattttgctccaccagagacactcaaaggataggacatgctcttggggctgctggcagccacctggataccatgtggaagcaagcctgctttagaatgaaactgtgagaaaggagagccagacagagaggcaaggaggtgaggcccaagagctgatgacacagttggagctcctagatccagccatgcctgcgaccagcccattccttgggtatgtgtgacacaagccaataaacgcccttctttgcagaagccagttgaa

SEQ ID NO: 265009 - DNA, 516 bp, Homo sapiens
ccatagtggtggcataatttttcatttctaccagtaataaataagagttcctgttgctccacagcctcatcagcatttgttgtcagtgctcttaatttaactcttctaatacgcatatagtagtatctcattgttatattttaatttgcaatctgtaatgacttacagtgttgagcatctttttaaatgcttctctgccatctgtatatcttcttttgtgaatgtcggttaatttacttggcccattttaaaattgggttgtttgttttactgttgagttttaatagttctttgtatattttggataacagtgctttaccagatatgtcttctctccccaaccatggcttgtcttttcattctcttaacagtgtcttttgcagagcagaagttttaaattttaataaggtctaatgtaccattttttttcctccatgaattgtgctgttgttgttgtatctaaaaagtcaaatccaagttttggcagttacaaataaagatgctgtaaacatcaat

SEQ ID NO: 265010 - DNA, 403 bp, Homo sapiens
ctggaagggcaatttttctaaaatgtaaatctcatgagatttactcttctgcttcagatctttccatggccctccattacccccaggataaagtctgaaatgatggttatggcccagaaacactgcagacctgaacttggcctacttcggatgccttgtttcccgtggctcttcctagggcctgtagctacactgatccactttgaagttctcgaataatctgcaacctctggcctttgtacctgcttctgtcacgtgtagtcttcctagttctcctccctcccacccctgacctaggtaacttttgatcattcttccaaatatattttaaaattcacttttaggggtccttcctcttgtctgacagacctgtgtgaactaccttagcgcctgcagccagaaa

SEQ ID NO: 265011 - DNA, 498 bp, Homo sapiens
ggaggggtgtactacctgttaggggtagactacccagacatcatggatatcttggtcatatgaaaatcctggtaacccaacaggaatgcttctcactatcttacctttaatgtagcataatgccctggcataaaacctctgccactggatggtcagggttcacatttcacctatccttttactattttgtcatgctatccaaagtcactgaacctcaggtagactcagccttttttttttttttgtaaatataacaataataactgtttcatagtgttttcacaaggattaattaaaatgtcgtaagcacacatctaggcacacactgagtactcaacaaatgttagttaacattgttattattgctgttgtcactttcatctattcctttaaagcatcaacaccttgttgttcacctcttttctttttcctccctttagtcttcttctttcacagaaatgatcagaagcctattacatttgctaaagtgctgatacc

SEQ ID NO: 265012 - DNA, 490 bp, Homo sapiens
tctcagcttctttatttattgaatagatactctaatgtccacactgctatgctcatctatctgtccatcatttatccatcttctagcatttaactttcactgttttacattttgcttataagagttactgatagctctcaaagaacataaagtatgtcacattcatctttatacctagagttcctaggccactattctaaacactttaaatgtattaaatcatttattcctcatgataccatgagaaaggtattctttttatccccacttacttcagacttaaggaggttatttgacaccagtcacaattacattaatggtgtcagatagatttgaacatagatatctggctccagagtccacgctcttaattaccatgctatacaagaaagcaacttaattttcttctcaaatccaggtgctgtttcagaatagattttcatatgtgtttttatctcgtttttctctttactctttagctcttgttttt

SEQ ID NO: 265013 - DNA, 462 bp, Homo sapiens
gtgaatgtaaacatacctgttaaaagataactcatgtgagttgtattatgttgaaaataaggaattgctatttgaccatttcgaactgcaaaactggcagtttcagtaaggttttaacctaatagatagctacccaatagatatctgacctaagcccagatttttaccttttgtggttctttcatcagctctttcttgattaagatgctaatttcacgttcaggggaagctgtgaaaagtcaaaagatggcaacaggtagatcagaaggctttgcagggaaggaaacaaggagacaggagctggggtcacaccagctagcaaaaccaggatctttattatgcagtcagtttagttgtaaagattcagcataaaacattttcctttcctaggtgggttaataggtggttgggtgcaacttcagctcttctgtagcctgctggagacaacttgtaagggacttt

SEQ ID NO: 265014 - DNA, 596 bp, Homo sapiens
taatattagaggggcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaaatagctgacagtgactgatttataaaagtaaaatatcttttgttaatactaatattctttttataaattaattgacgacaaaaaattgagtgaatgagatttgcagttcatttatctatgatgctggtttatttaatctctataatttgctgtatttgaaagagcatagtgatagaggtcatgataaaatctaggcccagtgccacaagtaaatccctgtaggaactctcaaggttttgatttcatttctgaatgggaataacaccttccaagaattttatgaagattagttccgttctattacccacagagtaacaattactggggattttgcacacttgtaag

SEQ ID NO: 265015 - DNA, 252 bp, Homo sapiens
ttccagcatgatgtggcctgaaaattcatctgaagacagctgctcactcccagggctaacaccgccccttgcatgctgatgtccttgtagtcattggtctgatgccacaataaataattcctaaggctggtgctctatttctgccctgagactctcccctttttctccaagctgtgccccattccttgttttagtccaggttccctacactccccaggccaatgcttttgaataaatcttgacgtcattgaa

SEQ ID NO: 265016 - DNA, 462 bp, Homo sapiens
ctggcggttccgggagagaacctcctacaacaaacaccgccgaagtttccctctccagcgcgatcgccaatcccaggagcgcccggcgtcggggctgggaaggagccgagcggaaacctggaagtgagccgcggcgcaggcgaatcctgccggttgctggtggcagcgccaagagaccccgcacagaaagtgggctgggagtctcgcttgctgtacccgcacctaagtgctcagaagcggcctttcgctctgcagagggggggtcttagaagcttggggaagaagcacattgtttcggagttccttgttgcgttctttctccttgggaggagggaattgcacaaggaaaagaagagaagcctttactttgtaactgaaattctccagagttgagttgcgtcgtacagactcggtgcatattttaatacaaaactaagggaagaggccatttgatacttggct

SEQ ID NO: 265017 - DNA, 711 bp, Homo sapiens
  misc_feature (593)..(594): n is a, c, g, or t
  misc_feature (612)..(612): n is a, c, g, or t
  misc_feature (619)..(619): n is a, c, g, or t
tgagccggaccggatggcgacttttaaaaatgtaaaaaccattagctagagggccacacataaacagacaacagaccacagtttactgatgcctgacttagagcaatggaaaagggctggcagcattgactggtgactgctgcatgtagtgagactaaagatagtacaaaacctcaccaggtttgacgaaggcaactacctctccatctgacttgcccaagtcagctatagctgtggcagagaatttaatctggaaatgctaggcttatatctttgaaaaattagataaatgaagttgttggttttgtgtttgttttattttattttttttgagacagtctcactctctcttgcccaggcagccaccctgcagtgtcgtggtgtgatcttggctcactgcaacctccacctcctgggttcaagcaatcctcccacctcagcctcccgagtagccgggactacaggcgagcgccaccacgcccagctaacccttgtatttttagtagagaaggggcttcaccatgttggccagactggtcttgaactcctgacctcaggtgatccacccgccttggcctcccaaagtgtctttnngtctaatactgaaaagtngcaaganacgttaactctctaaaccagcgctgtccaatacagtaaccactagccacatgtggctaatgcgcacttgaaatggtccgcatccgggggacc

SEQ ID NO: 265018 - DNA, 508 bp, Homo sapiens
tgagccggaccggatggcgacttttaaaaatgtaaaaaccattagctagagggccacacataaacagacaacagaccacagtttactgatgcctgacttagagcaatggaaaagggctggcagcattgactggtgactgctgcatgtagtgagactaaagatagtacaaaacctcaccaggtttgacgaaggcaactacctctccatctgacttgcccaagtcagctatagctgtggcagagaatttaatctggaaatgctaggcttatatctttgaaaaattagataaatgaagttgttggttttgtgtttgttttattttattttttttgagacagtctcactctctcttgcccaggcagccaccctgcagtgtcgtggtgtgatcttggctcactgcaacctccacctcctgggttcaagcaatcctcccacctcagcctgggaggttgaagcggcagtgagcagtaatcgcgccactgcactccagcttgggtgacagagtgag

SEQ ID NO: 265019 - DNA, 300 bp, Homo sapiens
gggaaggaggagaaaggatgaaagatgaagaaggaagagaaagaagggtcaggagcggtggctcacgcctgtaatcccagcacttcgggagtctgaggcgggtggattgcttgagcctcaggaattcaagaccaccctgggccaatatggtgaaaccctgtctctactaaacaaaaaattgccgggcatggtggcaggcatctgttatcccagctacttgggaagctgaggcacaagaatcacttgagcccgggtggcgaaggttgcagtgagctgaggttgcaccactgcactccagcc

SEQ ID NO: 265020 - DNA, 287 bp, Homo sapiens
tggcggggtcagggctgggtgcctggtttctgttcacatttactcttggctgggccatccctgtcctcttcctcaggcagcgccccccctgtgagtttactcatacctcaggctggagacacaggtctttgtacacagtctccacgctgtggcagacttgtttgagctctgtctccaaatggctgatctttgccattttctgggtgaactcttggagcttttcctggatgatcttgttgtggtcattataaatctgatagatcctctcctctaatttctctgtcaga

SEQ ID NO: 265021 - DNA, 303 bp, Homo sapiens
tacgtgtgggagactcggagatgacgctccgccccgcacttagagtcttacaagtgagtttcccatgggaacagttcaaggaagaatcaaataagcaatttcacagagggacacacaggttgtcacagaagtgctgcaggctcctaggtgccccctcttttccatacgttattgccaaagtaagaactaggcttggtgtggtggctcgtgcctctaatcagcatgagggaggctgaggcaagaggatcactcgagccaggagttcgacaccagcttgggcaacacagtgacaccctgtctcta

SEQ ID NO: 265022 - DNA, 413 bp, Homo sapiens
cattctaaagccaattggtggtgatagtggcacaattttataaattgactagaagtcattgaattgtacacttgtagtgagtaaactttgtcatgtagagtattccttaataaagcggttgtttttttctttttaaaaaataacctgcaattttctattctgtcagaaaaaagtttcaaattttataaaggagcagtctctatgagcttttagaaatgggcggcacatgcctttgaccatatttttgtagctctatgtagcagaaatgaagtggtacgtatgaatgtatgttgggtttaacagtcacactcgctgaccctgaaagttttatccggatgtgaggagagtttgaatctaatacagtgatgaaggggagggaggaaaacttccaaaagtgatttaggaagtcttgt

SEQ ID NO: 265023 - DNA, 431 bp, Homo sapiens
gcttagcttctgactcatcttttacagcttgctgctgaacttaactattaacttaaggatttattgtacatttaatggtttttccatagaaaaccatggcttaagtttggaaattgaaagtaagtgacttccagccaagttgttcataaattttctctttgatacatcccttttggttcaaatacacagcaataatagataaagtacagaactgaaaataaaatagacaaagggcaactaaggacaaagataaacatcttaatgtgccgaagaaggatcaagactgttaagattaatggctaaagtgaagtcctgctagttttaaggatcaaggagaggaacagaaagtgtagctcagaactcagcatctgcaggatgaaggaactaaaactcctacagaaatggacatgaagccaaaagatgtctggtga

SEQ ID NO: 265024 - DNA, 445 bp, Homo sapiens
aaataaatgggaaataaaaggccataatgattggtcttcaggaagctgtaaggattgttcttcaggaactaatttttcttgctactttattgtgtggacaatataatgcctcacgtatctgttggcatagtccctagtttctctctgctgtacccattcttcacatattttctagcattctttcaagaggatcaggagtctttgcccagatacctgtttgggaaaaggaagaaagagagtaaaaaattaataattaaatcaattttggagttattctgcagatgacacacagcagctttcttagtgtaatggaaagccagcctggtattaagcatctaacctcacaaagaatggcagtaataaaaatatctcttcaattaaaaagccccacactttagtttcaactaccaagccttggaaatgtaataaaaaaaaaactgtgaaa

SEQ ID NO: 265025 - DNA, 585 bp, Homo sapiens
ctcaggtctcaccccaaatcagggtttgcattttaataagactcccagcttattctaatgcacattacagtttgtggactgctgctctcaaagatgaaatagaatggattgtgttcatttatttttaaattcatatgatcagtaacatttattcaggatatgcactggaagttaagatggtaccctagctcttgaagggctcccagtttagtgatggagacagatgtgtggaagagatgtgttcaaagtggtttgatgtgccaaggagtgtgcctaattctgcctgtggaactctcacaaggcttcatggaggttacatttgagtgttgagtctttataaggagtacaaatatgtttgagaggaaggaaaagtcttgcagcccatggaggtattacatgaaagcctgaaagaacatgaaatgtgcagaaaatgatgagatttcaagttactggaggccaaatgtgtgggtatattgcagcacctggggatgggcttaataaatgtagcaatgttttctgctccatctacatagtaggtgatcagtgaatacttgtgaaaagaatgaatgaaaaagaaaaaaaaag

SEQ ID NO: 265026 - DNA, 310 bp, Homo sapiens
tccccactctagttctgaatttaaagaaagaaaaaggtaggttagcaaatataggtatcagttatttctattgacagatcatttggagaacatgtttttgggcgtgggagaaaaaagattcctaactctccgccccagaaataattttgctgacacaaaaatcagccagacatggtggcacaggcctataatcccagctacttaggaggatgagtttgaggataaggatacattgtgaaaaaggtgggaaaatcacttgaacacaggaggcagagattgcagtgagccaagagtgtcccactgcactcca

SEQ ID NO: 265027 - DNA, 182 bp, Homo sapiens
tcttggcctatttcctcccaactaggtttcccccaacagatgagtccttttttattttctgccacttagaggcaatttttgggttcactcattcatttctttaacagacatttttgattacctattatgtgtcatatgaagtgttgagaatacaatggtgaataaaacaccactcattccct

SEQ ID NO: 265028 - DNA, 401 bp, Homo sapiens
tcggacgagaaaaaaattcctcctaccagtattaatggcaatatgagagactgacttattctccttggctttgattttgtggagaaaggtctctcatcatgcaggtttgagtttgaatagacataactgctctgaagggacattctctcaacctagtacgtgtagattcccacaggtaaaagcattgcttagaatgaatttacaattccacattagttaatcacttgtggattgtaatctcccctgaaccaataatgggagtaagaacaaatggagtgatcagacccttaggaacgctggataatagaacgagagtataaactaaatgattaaaggacggactgagaggcatgggcacactctccagaatggatgatcagatatgacttgttaggatgttg

SEQ ID NO: 265029 - DNA, 418 bp, Homo sapiens
gcaccaaagcccctgtggacactgatgtctgaaattggaactgactacagtggtcaacagatgctctgggacccctaccatagcctgggggacacaccagggactggggcttcagcaacaggaagagaccttcaaccacgggcttgtggttcatggggactcggacagaagcacacagtcactgtggggtgaaggtggagggacacagcaggggctggagagggcggggctgtcattgtgtgggcatcagggcaggcaactctgaggaggggggcactgtgcagggtccccatcattcacctgcaggaagaggggcagagctggcaggattccagccacatgctgggcgagcacgcgtgggaggacctgctctgctgctaccatcttgattttctttatttttgcttttatttcctta

SEQ ID NO: 265030 - DNA, 722 bp, Homo sapiens
agaaggaactaatttcaggataagcttaatacacggaaactcctagaataatgcctctagtgcataggaggctggtggcagctgtattcattattgtctaggttatctttagaaagaagtctagatgcaagcttgcttccccttcagagaggcccggtagttttgatggtaagagcacaagccacatgcttagttctggagccatcttgtgccatatctaaatcacgaagaacacaggatcacaaagctcttatctacacgcagtgtcatgtccttaggggttcaaaaaactgtattttaaaaatgctagacatcatagaaattcattcacaataatttggaatatagaacaatgttactcgaagcccgctgcctgctaatcttctgatgtgtgtgcttcctgtctgcaggcattttttaaaagcctgcttttaacacagttataaccattatgaataagtttgtatcctgccttttttcacttagagtaatgatataagcatttgaacatcaccacagactttataacattctttcaatacaggaatattcattcagctggatgtatcatgctgttcttaatttcttaactggtgtaaatcgaggtgtgataaacatgtgtctgctaaaactttttctgtgtttatgatgatttccttaatatctattttcaggtgtggaattactgggtcaaagattctgatcattaaaaatattttaag

SEQ ID NO: 265031 - DNA, 365 bp, Homo sapiens
tcaatggatgaatgaatgaatataggcggtaattaaagtcatggaatttacttttgcaatatagtcttacaaataactggcactcctagtccaaacacaacttttgttttcatttgtttgcctttcaagcaagttataattagaagacatattttaggtggaatggtaccttttatagtaatctttattgggtctcataaaaatgactgactcacaaatctcacagagtaagactaagcttgaataagaatttttacaactcaaggtataaacagttcatgttgctattttttttaaagtactagctaaaacattccctgtaggttcactctatttaatatgtgactagctagttaaaaaaaaaa

SEQ ID NO: 265032 - DNA, 366 bp, Homo sapiens
aatagccgggcgtggtggcaggcacctgtggtcccagctactcaggaggctgaggcaggagaatggcatgaacccgggaggtggagcttgcagtgagcagagatcgtgccactgcactccagcctgggcgacagagcgagactccgtcgcaaaaaaaaagacagtaatattggtgtagtggtaaataaattaaaccaataaatagaatagaaagccccaaaatacacccttatgaatgaggtgtgttcttggccattatgaataatgctgctataaacgtgggtggtcaaatatctttttgagagcctgttttccattcttttagatatatacccagaagtgggattgctagaccatgtgataata

SEQ ID NO: 265033 - DNA, 680 bp, Homo sapiens
agtggttccatctactgacctatgcatttgtaaaggaagtgaatttagtttatatcttgtcactctagccttcaatactcatctattccagtacgttttttttgtagtttccctgttttctgtccaaagttgccactggtatgacctatttttgttgggccctgctctctacctgttgataattggttcatttgatgaatatcctatgttaacctgttcaggtaacatacttctgcaacccatttaaaatgcatatccctggaaagggcttataaggatggatcttagtgctaggaattcccatttagctcaggatctatttttggctttgtccttgggagggattgctattatgttgaagtctggacatctggtctgggtttggatctttggtggctttttttatgaagagagatgtgctggaccagtacttaagattgttttggcaataatgattatgtcttattaggcaggtagaggtaaaactgttaagtaatagtgatttgtatattacaaaaaaaaaaaattgaaggcaactatctgcttttttggttagagatattagattaaataattctttgatgtttatccagatttttgtcttcaatttgcatgcagggttggtatattttgtaaaaacttaaattcatctaagaaatgcaaatgctaatgttcaccct

SEQ ID NO: 265034 - DNA, 467 bp, Homo sapiens
ttttaaaatcacatactttgccctgatatgccatggaaactaacaattgctatcctgggtatattacaagaacttctctctatttttttatatttgctttggaataaatatttgataaaacgagggcaattttcatagcaacttttcttgaagctttttaaaatgtaattaagcattttaaaatctatcagatatattcagaacatttcccaaattgttttcttaaagatcaattttgttcagatactttaggttctggggaaaagctattttctgtccactttgacacaaaaacattccttctagttttttaagaacacagtactttgttgagatgttggcttcttggtttatggcatgaattctaatcacttttaaacttctaacttttattctacacttagagttcaagcaaaatgacaatgatcaagtttataaaatataaaacttctatatgaaaagcgaga

SEQ ID NO: 265035 - DNA, 530 bp, Homo sapiens
atttgggttgtttccatttttttgcctattctgaataatgctgttataaacatttgtgcacaagtgtttgtatgaacacatgttttcatttctcctaggtgtttatctaggagtagaatgtcttggtcatatggtaacactatagattgttttccaaagtggctgcccatttcacattcccaccagtagtaggatttcaatttctctacatcttcaccaacacttgattacagccatcctaatggatgtgaagtggtatctgatgatggttttgatttgcatttccctaaaggctaacaatactgagactcttcatgtttcttagccatttgtatatctcctttggagaattatctactcaaatccgttgcctgctttttaattagattgcctttttattactgagttctgagagtttcttatacattatatatatacaatgggcttgttttcctatctctaggtctagaattatcctttccagaattctaaaattttctgatttcaaaatataatactcttgtgttcat

SEQ ID NO: 265036 - DNA, 435 bp, Homo sapiens
gtgggatatagtctcgtggtgcgccgttttttaagccggtctgaaaagcgcaatattcgggtgggagtgccccgattttccaggtgcgtccgtcacccctttctttgactcggaaagggaactccctgaccccttgcgcttcccaggtgaggcaatgcctcgccctgcttcggctcgcgcagggtgcgcgcacacactggcctgcgcccactgtctggcactccctagtgagatgaacccggtacctcagatggaaatgcagaaatcacccgtcttctgcgtcgctcacgctgggagctgtagaccggagctgtagaccggagctgttcctattcggccatcttggctcctcccaaatctccttttttcttatcttaatggggaaaattgcattttatatattaaacaataacatgtgtcttagataaacactta

SEQ ID NO: 265037 - DNA, 351 bp, Homo sapiens
gtgggtatgtattcttgttatttttgaatgtcttgtgaggaaactaaagcacagagatgtcccaggacttggcggttgtcacacagctaacagtttgcagtgctgggattcaggcctaggagatctggtttcattcatcagggcctgtgctaaatggtcgagtgaagaggctgtcagggaagagttggcctgttcagaacaggtggtcttataagacccctctgaggaggcaacatttgaaaaccagaataaaatgagagaggaagccacatggccacgtggagaaagagcaaacgaggtttcagcaaatgaaaagttttgtataaacgagattatacctggtattctgta

SEQ ID NO: 265038 - DNA, 625 bp, Homo sapiens
tctggctggaatgcccctttcacccttctcttctctggtttctattataaggaaatctagcacaaatctaaactcttgagttcaggagtaacacaggctggaatcgaattcaggctccacctcgtataaacggtgtcatcttaagcaagtcacttttctttgcatttcggtctcctcctttgtcacataaagaacacctgcctgattgtattaccatgggctaaactaattgaacacaaagcacatagcacagtatctgccacagagtaaatgctcactatatgctcaatagatatttttactataggcactcaaccttgacatctcagattagatacgtttccccagtgcccaggtccactttagatgttctttccaaggctcttgcagcaatccacagatgcctctatcataattctccttccatcattcaagtgcccaccttatcgctggcagttggtttatcatccctcacttggcgtgtaagcttctcaagattaggtatctgccttacacatttctgtttggccagaccagctccttaatatttaatatgtgatgacgtccagggttttaattttattaaacactgaaagagagcttgttaaaatttcacaatatgaca

SEQ ID NO: 265039 - DNA, 391 bp, Homo sapiens
ctcacttcctcccctgctttttaaaagtgaagccatatggaggacacctgcatttcttcccctaagctagttttggaaataaattactttctttataccagacttcacttttgttaattggactctgcaagcaacaagcgactaacctgcattttggttacattaccatgttttaggtgggacaaacttctaatatttcaaatgtaacacaaatatcaaaccagtaaagactttatttaggaaccaaacccaggctgccatggtggaaaaagggcagaaccttagctactgaactacagcatggggcaaccactattgctatttcagtttggcttggctagcaaagggttgttttgttatgtaaataaagcccttcaggtaattgaaatct

SEQ ID NO: 265040 - DNA, 555 bp, Homo sapiens
ccccaaactcctggcctcaagtgatcctcccacctcagcctcccaaagtgctgggattgcaggtgtcagcccccgctcctggtctacgtgccatcttttactcactcatctgggagccgttggaggcaggggacactccacccaatccccgaggccggggcttgtaagtgggggcaggtgcgctctgaggctccagaccttgtcagggtccctgccgccagcacactgctggggatccccctgcaggcacatcgggcttaaaaaggaaatacactatttcatgacttcacttcttttatttttagaacaagtgactcatctccaccacaggggctctgtgagctgctcccggacaggcttacagaggccaagcagggagtgagaggctcgagagggctgcagctgcccctgcccacactctgaggcccatgagtggctgagatgcaaggcagtcggtcgttcccactgacctgcccctccaaaatagcaagtctggagaagccgggcacctgcagaagaggtggctgcggcagagggtgcatccatctcgtcccg

SEQ ID NO: 265041 - DNA, 477 bp, Homo sapiens
agatgttcccatctaacataatccagctatctaccacattgtggtggattaaatatggccacacattctttgcaactctcccattatgaggtggagcctatttattcattcctttgacctggactgactttgtgacttgctttgaataaaggaatagaacagaagtgatgttgcataagttctggagtttaggcctcaagagagcttacagtttccaccatcgctctcttggaacattgtctaccatctaaggaagtcagtctatcctactggaggatgagagaccacatggataagaactgagaccctgagccaatggccagacaggtgaatgaggccatcttgaactttccacacatgcagttgcctgagaaagtccagatgagaccaacagaggaatggtctggaccttgattctgtacagccaacccacagaatcatgagaaataataaatcattgttttaagccacagagct

SEQ ID NO: 265042 - DNA, 1492 bp, Homo sapiens
  misc_feature (971)..(971): n is a, c, g, or t
gctaggaaagctcatctggcctcctgttcattggcctcctgttccagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagngctcaccccaggcttccctggtgtccatcataccccagggcaaggggctccgctacgcacagtacctgccccgggagcagcagctctacacccaggagcagctcttcgaccgcacgtgcatgatgctcgggggccgggtagccgagcagctgtgctccgggtagatcactatgggggctcaggacgacctgaggaaggtcacccagagtgcctacgcccaggttgtgcagtttggggtgagtgagaagctgggccaggtgtccttcgacttttcccgacacggcaagaccctggtggagaagctgtacggcgaggcaagcgcccagctccttgatgacgaggtccggcacctcgtcagtgccacctacaggtgcaccctggacctgctgacacggtgccgggagcatgtggagaaggtgggccagcggctcctggagaaggaagtactggagaaggcagacatggtggagctgctgggcccccggcccttctcggagaagtctacctatgaggagtttgta

SEQ ID NO: 265043 - DNA, 1043 bp, Homo sapiens
  misc_feature (522)..(522): n is a, c, g, or t
gggggcctcttcggtgttggtgagacagcagccaagatcttaaaaagcaacatcgatgtgttatttgcagacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagngctcaccccaggcttccctggtgtccatcataccccagggcaaggggctccgctacgcacagtacctgccccgggagcagcagctctacacccaggagcagctcttcgaccgcacgtgcatgatgctcgggggccgggtagccgagcagctgtgctccgggtagatcactatgggggctcaggacgacctgaggaaggtcacccagagtgcctacgcccaggttgtgcagtttggggtgagtgagaagctgggccaggtgtccttcgacttttcccgacacggcaagaccctggtggagaagctgtacggcgaggcaagcgcccagctccttgatgacgaggtccggcacctcgtcagtgccacctacaggtgcaccctggacctgctgacacggtgccgggagcatgtggagaaggtgggccagcggctcctggagaaggaagtactggagaaggcagacatggtggagctgctgggcccccggcccttctcggagaagtctacctatgaggagtttgta

SEQ ID NO: 265044 - DNA, 204 bp, Homo sapiens
aagatgagaaaacttaaaagaaactataattaatactttcaaataattaagacattgcattcatgaaacaggaataggatgcttataaaagaaacattcagagaatgaccatcaataacaatagcatatattaaaagaacaataaaaaggttagaagataaagttgaggacatttccaagaaagtagaaaacaataagagatgc

SEQ ID NO: 265045 - DNA, 359 bp, Homo sapiens
tctttgggtgaggagtccagtcacatttagctgggtcctttgcaaggcgctgtaatcaaggtgttggttagggccaaggtcttatcagaagctcaattagggaaggatctgcttccaagcccatgtgattgttgacagatttagttgctttcacatagccttctttataggtagttcacattcatgacagcttcttcaaagccagtaaggaagagagggtcttctggtaagaaggacattatattcttgtggaatgtaatcatacatacgctgtcacctttgccatattctgttggttagaaggaagtgataggtcatactcatactcaagcagggagaattacccaatggtttgaata

SEQ ID NO: 265046 - DNA, 328 bp, Homo sapiens
ctactatattttgttggatcatatgaatagaagacaaatcttcaagtctgaacaaagaaaacaccttgataagttcagagctgatatgatactgtctaactcattattaccatcaattatccctgaaactactgagattgatatatgctatgtaattgggccttattcctggcagaccatgtcaaactcaaacctttaccatcagagtgaacagggaacctacagaatgggagaaaatttttgtaatctactcatctgacaaagggctaatatccagaatctacaaagaactcaaacaaatttacaagaaaaaaacaaacaaccccat

SEQ ID NO: 265047 - DNA, 281 bp, Homo sapiens
  misc_feature (245)..(245): n is a, c, g, or t
gggaggggccggtgcaaggcgaggggccagtgtgaggcaaggggctcacaccgacctttgtcagcgtgggaggggccagtgtgaggcgaggggccagtgtgaggcaaggggctcatgcggacctctctcagcatgggaggggccggtgtgaggcaaggggctcacgccgacctctcagcgtgggaggagccagtgtgaggcagggactcacactgacctctcccagcgtgggaggggccggtgtnaggcaaggggctcacgctgacctctctcagcccggg

SEQ ID NO: 265048 - DNA, 474 bp, Homo sapiens
caccctccaccactgccccgtaaggccactggacacgcagcccatcagttctcttcacgtggtcatccccctttagatgggagaaaatacacctgcctcatttttgtaccttctgtgtggacattccatgacagagcttcactaaatgtatgatgaagaacgaatgaatgaatgaatgaatgaatgaatatgagagcaaatgaatgaatggctcagatcctgggctggaaggctgtgtatgaggatggtgggtagaggagggtctgtttttcttgcctttaagtcattacttgtcattttggggcaggagcacaggctttgaatgccgactgactggactttaatcctggctttactagctgtgattgtgtgacctcgtacatgttacttaaaccctctgtgcctgtttctttatctgtaaaatggagacaataagatgacaaaggactgtggtaagaattaaatgctttaaaa

SEQ ID NO: 265049 - DNA, 3351 bp, Homo sapiens
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtcgggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaata

SEQ ID NO: 265050 - DNA, 3324 bp, Homo sapiens
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtcgggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaata

SEQ ID NO: 265051 - DNA, 849 bp, Homo sapiens
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtcgggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggc

SEQ ID NO: 265052 - DNA, 916 bp, Homo sapiens
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtcgggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttataggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatgg

SEQ ID NO: 265053 - DNA, 359 bp, Homo sapiens
ctgagagactgattgtctcaagcctcatagccactattaggggaagccagggtttgagcccatctgtgtgacatgtgataaattatcatataggaggaaaaaattagtagtgataatactgatctccagacaaagcaaaaacctcctatgaagaaaccttagcttctcatgtctaccctgagctaatttcctgacctgaggttgtttttcagatgacaactggatgggtggaaagaatgttaacacatcactcattgaatattatctagccacatcctcgtaagtcccttctgtagatggccttatctgctgttttatcctgtggatctaactctgtttgaactttgagaataattaaa

SEQ ID NO: 265054 - DNA, 391 bp, Homo sapiens
tgaggcccagcccactggagaggcatatcccataatccgctcattcatatggaaattcattatttttcaccctccaggtgcccattttagtcagaaatcatttgtatggctatggaatcacttcgtcactgggcttgactatgccaaggtcacaaagttaaattagtaccacagtcgagaggtaactcaagggcaatttgttccactttgcttgctcttctctactgagctggcctccaagagtcatttactcgagtttgtctctcctgtccccaaaagtggtagtgacctgctttgtgacatcccacaaagagcctccggctctagcaatgggagggtagagtgaacagaactgggtttagaacctcactctggcacttgccagtttcta

SEQ ID NO: 265055 - DNA, 384 bp, Homo sapiens
cagaacagtgcctggcccacatttaacacagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgtttt

SEQ ID NO: 265056 - DNA, 417 bp, Homo sapiens
cccgttttcctccaagatgcttctgtcagttgattttggtctctatcttgcatcgttagagactttccacagttgtcttggttgtcctctcaggtgtaagggtggagattaaacagctggctctgaacatgtgagtggggcttattcactatgagatttgctgtgggatgatctgagtgggccagtatcactgtctttcctcctttcccatgggaatagtcagatttctcagtatgcttcccctgtcctgtctggagggcagtgttctgggaatgaggggctggtgtcaggtacagaagaggtcttccagtttggcatgcatatagtaatcatctatttttggtaagggacacctcttctacaataatgcctagcattcctaggaccagagactttttgctaaactttgcttgagaa

SEQ ID NO: 265057 - DNA, 474 bp, Homo sapiens
ttactccggttgcccacactgcctagcaatccttgaaccaggatgccttcaaagcattccttgggagattccagaaccattccacctcgttaccctcccccaagaaggggatgttttatataaagaaaaaaaacaatttttgtgttgcccatcctccctacctcaatgacttcctagagggcaacagaatggccaggtgagagctgctgtggggttagaactggaaagaatcagatctaatttaacatccttgttttcagatcatggaacccgaggtccagagaggtcaaggggcagctacttgatcccccacttagtctgtgtttccaccacaccacattgggacatagcccatgagcctgtccacagggaaccccagtcagagcttcatccccagtcagggacaaagacttggaacattccggtcctggccccctctacagctaataaaaacctttgggcaactcctttaaa

SEQ ID NO: 265058 - DNA, 608 bp, Homo sapiens
gagaagtcgggttgaaaggtgtgtcgtttgcgtcctggatctcccttaatttaaccccataacattccattttacagataaggagactgatgctcactaagacactaatatgcccactcacacagcaagtcccaagtctctccccaaaatgatttgagaattttgaggcacacaaaagggagaaaattgagtgcccgtgatccaacgttctgcaactgtttggaaaccaggaaagtggaggagtggtagtacttctgaaccctaactaaaatatatcagcctgcaccatcagcacagcttgcagatgaatgtaatggccaggctattaaaactgaagtgaagtgaagaagttacaactgagttcgaattctgactcctccacagattagccatgtgagctgggaccctcagcaaattttttgagcctcaggttccttatctgtaaaagggtagtgataatgatggttattaaatgcttatgacgcatgaaacagttctatggggtaggttctgttattaccgtcctttaaagatgagcatcctgtggtttcagtaacttgctcaagattgcaaagctactaaataaaagccttctaaatttgaaccca

SEQ ID NO: 265059 - DNA, 383 bp, Homo sapiens
ccagaaggaatgcagaaagaatgatcagagagatgagaagattgattggtagaccagaaggtgataagagactaggagaaaatgtttcagaaaattaagagtaggctgggtgtggtagctcacgccagtaatcctagcactttgagaggccgaggcaggcagattgcttgagcccaccttggcccccagagtttgaaaccagcctgagcaatagggcaaaacactgtctctacaaaaattagctgagtgtggtggcacacctatagacccagctatccaggaggctagggtgggagcatcacctgagctcagggaagttggctgcagtgagccatgattgtaccactgcaccccagcctgggtgaccttgtctcaaaaaaaaa

SEQ ID NO: 265060 - DNA, 531 bp, Homo sapiens
cacaaatgtagcatgcctataaaatggaatgaatgacatatatactacagcatagacaggcctcaaaaatgttatgcgaaatgaaagaagccagatgtaaacagcttatttatattgtatgattctgttatattccattatcacaaaagggaaaactagagatgtagaaagcatatcagcagtcacttggaactgtcagtgggagaataattaactgaaaatgagcacaagataaattttttgaaataaaggaagtgttctaagacaagacagagttaatatttgcagaatagtataaatttactaaaacaaatgtacacttaaagtgaatgggccgggcatgatggctcatgcctgtaaacccagcacaatgggaggccaaagtaggaggatcactcgagcccaggaattcaagagcagcctatgcaatacagtgagacctcatcttaacaaaaaatcagaaaattagccaggcatggtggcgtgcacccatagtctcagctactcaggaggatttcttgagccctggag

SEQ ID NO: 265061 - DNA, 377 bp, Homo sapiens
caccacacatgggcaacacaattgctgtctctcatacgagtgttatcacattccaggacttaatttttctggttctcatgagttgagccagtggctacttggtgattttccttcacagacaccagaaaaataatccacatcttcacaacaacagctgttcctctatagcctcccatgagaccggaaccatcacgactgcgctgctgcttatgatttgcttcgttgtatttaatgtgagcaactcgtgccacagcatttacctaagtacggtgaagaaaagggatcagttgtggaccatctcagatttgatttcctcatgttaccccattttttggtccatttttgctcattggtagagaaagtcttatcctgaattc

SEQ ID NO: 265062 - DNA, 388 bp, Homo sapiens
gataaattggaaggaaaaagggcttaaagcaggtttgtaagtctgcaggactaattccattcagttctgagacttgaaaatagttctctgtggcttgatattctgttctctaggcccactggcatggccttaccccttggtcctgggttggcagcctgccctttttttttttcttatgactacttagttcctgttttgttttgttttgtttttctacctttttaatcttaagtacagatgcttcttaagttatgagcagattacattctggtaaggcaagaggattatttgagcccaggattttgaggctttagtgcgtgattattgcacctgtgaacagccacttcactgcagcctaggcaatatagtgagaccccatctctttaaa

SEQ ID NO: 265063 - DNA, 336 bp, Homo sapiens
cattttagaactttttattaataagcaattctgagtgaattaagtagaaatcttcatttttatgattctcccctttagctaacattttttaggataccaagcaatgttctaaatacttcacatgtactgactcacttaattctcttaacatctctttgtaactggtactatttatccccattttacatgcacagagaggttcagtaacctatcaaaggccatacaagtaaagagtggataagctaaaatttgaagctaaatagtttttggttctggaacttgcactgtatgttgactgcatcagataggaaggctttattttatcatattatttta

SEQ ID NO: 265064 - DNA, 571 bp, Homo sapiens
gtcttcgcttccccatgccgcctccgcccagccttggggttgtctgctgggaaggcagagggcaggggtggggacctcaagtcatctcctccaggacaggccactccctgacaccctcagggtgaggaggagggtggggcgcacactgtctgtgagtcacagagcttccctctcccctgtgccggggcagcactctgggccccatcccatgtctagacacagggagaggatggtggccagcagatcaccctactccaggccaccctctgctctccagcctccttttcctcctggggtcctgtcctttggaggataaccactcacagcccccaggaagtcatcgctcagccgctggttaggaaaccaacaaagcatatggccaggctgagggcagtaagcgtcgaatgagtggaacggctgaccgcccacccatgcattcaagggcgtaatctccacggtaatgctgctgattaataggtccagattgctgggcgtggtgactcacgcctgtaatcccagcactttggaaggccaaggtgggcggatcacctgaggtcaggagtttgagacc

SEQ ID NO: 265065 - DNA, 412 bp, Homo sapiens
cctaaaaatgatttagaattaataaccacagaagtgtcttttctcccatgtaacatcatgtggcacattaatgtcccatggagcacattttgggaaatattcctttgaactactgatgccaagggcatcttagacttcctttaccatgtactgtcatggcagagtgtataattaagaatgggctcccacattcttcagagtctgtaccctttctttgcagtctgtaaagagagaaaagtcaggacaaatatattagaatgcagccctagtccattagttccatttgaagtcaccatggttgatggaatatgtcataactgtccttataagcaaggatatccagctcaccttttgttaggcttgataggaaccaagagggttcaagctgagggaaagaaagcctaatgctatt

SEQ ID NO: 265066 - DNA, 399 bp, Homo sapiens
aatgttaaatgataagcccaaagtctcctagcgtggaaacttgttgagacagcaggaagtttcacagagttctagactgttagaatgtgaagagcctggaaatcatcatgctgctaacatcattgaagaggaagaaaccagagctagaagttgagtcacttccccaagttcccacacagggtttctagaactggaaccacaaccaagtttcctggctctgaggtcagttgtctttctctactgcatcacagagcagggacgccgtcacgggggtgttgagacattaagtgagctggatcagacaagaatatatccatgtttaccttcgccttataacttatgtagtcatctgtgtcctggaactaagtaattcaattgctaaaacgttgaaagttctct

SEQ ID NO: 265067 - DNA, 1579 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 265068 - DNA, 1505 bp, Homo sapiens
tgccagtagagctcggtgtgaatcggccgaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 265069 - DNA, 923 bp, Homo sapiens
cgaaacgtgccgtcagttacaaatgtgagccaccgtgcccgccctcaaaataaaaatgtagaaaacattgattttggtggatctatcttgacaaccatatttctccgtgagaagcttcagctgttcctccttcttcgtgtccatcttctgaaatgccctgtaggcattatagtacaaaaccacaagttatcagagcagaacagattatagtctccacaaatataatctataatatccagttttcaacaacaacaaaaaaaaaattgctaggtatgcaaagaaatagaaaaaaagcagtcaacagaaaatgactcttaagtgggcctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 265070 - DNA, 451 bp, Homo sapiens
gaggtggttggatcctcgagccctagggactacttagggatgtgagctgcttccctggtcgctccctgacccaagccctgccccaccccagccatggccaacactcctcaagaactggcagctcctggcagtcaaccacccaggctacatggccttcctcacctatgatgaggtccaagagcgtctgcaggcctgcagggacaagccaggcaggtaaagggtccagggctcagcagaacaaggctgcagggctcagggatctgggctctgggctggtgcgtggtggagcccagatgtccttccaagagtgggaacagaggtacccaggaccccagagagttgataactcagaggcaggacactgagtgcccctcccagcccgcctcttctctcgaggcctcctgtactgtcccataatcctgcagctaagggacagtgcccgctctagcaa

SEQ ID NO: 265071 - DNA, 534 bp, Homo sapiens
ccctgccaacaaacccctgtcccaggtgctcctggagggacagaaggacggcttgtgagtctccattctggtaggaggagggtgtcagcaaaatctggttggaaagatcttgcatgttgtgcactgccggtggccaccacgtttgagggtgcaaccattcacataggggacatctcaaatctgcagtactacaaaattccagcaggtggcagtcaaaggtcttgaggaaggggcgcctctgagggtcgcacaaagtggccatagatcgggcccagccacagctccgaggagaagtgtgtggggcattgggcacaaccgcaagggctccattccttggaactgagctcaagagcgtttgcttctattttcttcctcttttactttagttaatttttaaaaaatgagatggggtttcgccatgctgcccaggctggtctggagctcctgggctcaagcgatcttcctgcctcggcctcccaaagtgttgaaatgacaggcgtgagccaccgtgcccagccagcttttgtttctaga

SEQ ID NO: 265072 - DNA, 1720 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcctccagggtgcaaaggaagagtgcagtggccagcagggggcagcagagggcagcaggcactgggaaagggccgtccccaggcctggtccccacctgaacaacaggagtccaggccccagcccctcctccctcagactcaggagtccatactccagcccctcctccctcagacccaggagtccatactgcagcccctcctccctcagacccaggagtccatactccagcccctcctccctcagacccaggagtccatactccagcccctcctccctcaga

SEQ ID NO: 265073 - DNA, 1858 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcctccagggtgcaaaggaagagtgcagtggccagcagggggcagcagagggcagcaggcactgggaaagggccgtccccaggcctggtccccacctgaacaacaggagtccaggccccagcccctcctccctcagactcaggagtccatactccagcccctcctccctcagacccaggagtccatactgcagcccctcctccctcagacccaggagtccatactccagcccctcctccctcagacccaggagtccatactccagcccctcctccctcaga

SEQ ID NO: 265074 - DNA, 1323 bp, Homo sapiens
tgccagtagagctcggtgtgaatcggccgaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcaggtaaagggtccagggctcagcagaacaaggctgcagggctcagggatctgggctctgggctggtgcgtggtggagcccagatgtccttccaagagtgggaacagaggtacccaggaccccagagagttgataactcagaggcaggacactgagtgcccctcccagcccgcctcttctctcgaggcctcctgtactgtcccataatcctgcagctaagggacagtgcccgctctagcaaggagcccaaagacccgcttgagggtaaggtccgtttctggtaggtcagagtcatgttgtaccatctgttcagtattttgagtatgaatttcccacctgttggcataggagactgaaaaacaagacatgagagtccttaaattatttcaaccaggagttttgagctgttgggtccccctagagggctgagaattgagctgtctagataccaagagaagagaaggtcaggtttgtgagtctctgcagggctgaggtgcaggggtaggacggtgagtgcgttagcattcttccagttacacttcaaacttatttaaggga

SEQ ID NO: 265075 - DNA, 467 bp, Homo sapiens
gcaacttctggaagtttctacccagttggcaaagaaaccttctcaatcccctacttaccctaaactaagaggaccagaaagtctgcaggccccatgatatgctacatctgctgacaccagggaaactccactacaagggagttgcagtctgtcactcaacttgctgaggaccaactcttgggggcacagtccctacctgcaagctgcttggatctctttgacagaattgtcacagccggacaattgttggagcaaagaggattcacgtctcatgataatttccatggctgcagtgttatgctgagaaggatgttgagggcccgtcttgtcttggcaggaagagcgttgtctggggagaatgtgataaagaggagtaactgaagataattggagactaacgtgatttcctcactgccataattagtggcagaggtgggactggaacacaggcaagaaacatcccaaaa

SEQ ID NO: 265076 - DNA, 403 bp, Homo sapiens
acttgcttaggtcagggtatggattaactgtgcaccaatttcttctcagaagggagaaaactttaactgccatctccactttacgcctgagttgctttaagattagcctttggaattctcaagcaaacacgtagttagatatatgtatagcaagaaaaaaaaatgagggagggattactttttaaagcaagctagcaaattggccgtactggttactgggagagagcatcaatgagaaaagaaatagattagcactgagtattaagaaacctcaacatttaacaggttattgttggcagacgagcattcagtggagattgtaaagtggttagaaatgtgtgaggatgaacaggagagggtaaggagggtacttcaagaagcaaagagtgatcaacaaggacaa

SEQ ID NO: 265077 - DNA, 390 bp, Homo sapiens
gcgcccggaaagccggggaaccggaaccggcctaaagccaagataagagtccgctgatttgacgtcacaagcaggctgcctttctccggtcccgaggctccagccttgccgcccttcttcctgatcgcgcaagcgagagctggttcgcagcaacgcagtgtcttttgtagactgatattctggtcctttttattaatgggaaggagggaatttagtaatctctctgaataggtgtctgcaggttgctgctgtagacgagcttaaaatgcagccggtgatttcagctgtttgcacactaaactcacctacattgtttacttaacccatcctaggttttaagccccattaagaggccctgcagtaaaggaagaacatgacgtgggctttaca

SEQ ID NO: 265078 - DNA, 349 bp, Homo sapiens
ctttttgatttgaaaactgacttggacagaggtcatatttctgtaaaagatcttatcggagggtgggtgcaggtcctgagtttgaagtccaggctgtggaagacttaacaagcactcctggtttagggtttgtttatgattgagagctatattaatccaaattcacatctttttttcttaactgaaaatatcttattgttaaagatgaatacaggaagtaacaaatgcatatccctcaaaaattgtgctgagtgagaaggcacatggttctctgttaaagggtcgtaaagtcctaccctgctctgtactactattaatatatttatttctctaacacattaaaaaaaaa

SEQ ID NO: 265079 - DNA, 430 bp, Homo sapiens
aactgagaaggaggaagatgtgacaggatttattagagatagtgtggcaaaatggctttgaagaccagcgaatctgcattagaatcctgaccacgctatttactcgttacgtgaattgcttcattttcctgacatttcgtttccctacaaaacttggataataccatttaactcaaaggtgggaattactccattggtgtgtggcacttcagtaggtactcaatgttatttttgtggtaagcagaattataagatggcccccaagacccctgctcctgggtttgcattcccgtaagggtgggcaagacatggtcatattacgttatatggcaaggggattttgcagatgcacttaaggtctctagtgagttgactctgagttagtcaaaagggagattatcctgactgggcctgaccatagcaggtgagc

SEQ ID NO: 265080 - DNA, 492 bp, Homo sapiens
gctgtcattcaattacttaatctctccagcatgccacttcctcaggccaattcatatgggaatatgaattcataggagtgttataaagggtagtttatacaatgagctcatgactatgaaatgcttagcatggcatccaaaaagccctgaataagtggtgcaacaatacctttttattacggaaaagacacccaacctagaaaagagtgttcataggggattaagagaagtaagtacagttagtgagcagagcaagccagcgtggtgagggcctttcctaggtgaggcatccaccacatttgaaagtgggatgcagggcaagagctcaacatcaaccaggatgggcaggaatgaagtaaatagctcacacctgttccttcatgggtcagttcctttcattttcacttttgactctgatgcaaaattagaactcttctctgctcaaatgttactattcttaataaagtaaagtaaataagtagggtccaaaaa

SEQ ID NO: 265081 - DNA, 306 bp, Homo sapiens
atcacctccccaccctgagaggcctcttttctaggattaaggcctcaccccccagccaaggataatagcctcaccggagagatcattgtctacctgcaagaacagtgaaaagtgacctgaaagaagatggttctcattcgtctctctctttcatctccttgaaatatctagccacagggtaacacaggttttgagaggatgggaacggaacgtggcaaggatctgtgagtgtgcaggctgtgtttcacatatcattaaacttagtctagtgagggttctgcaaaataaatgtagttgttttaagac

SEQ ID NO: 265082 - DNA, 332 bp, Homo sapiens
taaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttct

SEQ ID NO: 265083 - DNA, 298 bp, Homo sapiens
agcacaggaagacagatttgagcttgacctttgtctctttgtgaattgactttcaatataaagctttccctttctcagaaacatggtgtcatagtaccggcttcaagcgcatcaggcaatgaatccatttgctttaataataaaagcagtgagcttgtggtcaagaattgcatcagtaagtcaagacacttataaaaatgtgtgggagaaaaaagcaatcatcctaaaaagaaacaaaaataaaatacataaaacccccaaacaacaaaaatagcagtttactattgtattctagaaa

SEQ ID NO: 265084 - DNA, 362 bp, Homo sapiens
gtagaacatttcccaaggttgtgttctaattgcgtacctccacccaacccttcacctaactgtggtaaaagaaatttgatttttataaagagaggaggccaaatgagacattagcagagctaagtctacccagattgctgaggaacagggaacttagcttctctcaaagtttccaatgatcccttcatccccaggacagagtgacactgcacccacactactgataccaacaccaactgtgtctcccacatctcaagagctattaaaatttaaacatgatattaatagtaactacatttattgaccattttctgggttccaggcccttcatatacatatctctgagctagctactactaatc

SEQ ID NO: 265085 - DNA, 320 bp, Homo sapiens
tctttttaagccggagtatgagcaatatcttatcagctcacgatacatttatgaagcaatatcctaaagtattcctgcaccaaaaacccagacttcctaaacttttcaaacaggaggaacaaagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgtaagtatttaaaatatattccttcttctaattgaaa

SEQ ID NO: 265086 - DNA, 472 bp, Homo sapiens
ttaaatctggggtgctggcccaggaccgaggccaagccatcaaatgtggccaccctgggctttgtcatgggggccagtggtgggaaggagcagggtgtcgtgggtagcaattagctaggcccagtgtctcaggtggtaaatgaatttatcaagacagctgtaaataaagaaaagcagatttataagagaagatatagaaaatacgttgcgtggccgggtgtgatggttcatgcctgtaatcccaggactttgggaggccgaggtgggcaggtcacaaaataaagaggttgacaccatcctggccaacgtggtgaaaccccatctctactgaaaatacaaaaattagctgggcgtggtggcgggtgcctgtagtcccagctactcaggaggctgaggcaggagaatcacttgaaaccgggacgtgggggttgcagttagccaagattgcatcactgcactccagcctggagaa

SEQ ID NO: 265087 - DNA, 428 bp, Homo sapiens
gctgggtgtgcacaggctgttttcctaagacttttacttattacatatattttttgagatggagtcttgctctgttgtccaggctgcagggcagtggagtgagctcagctcactgcaacctccacctcctgggttcaagcgattctcctacctcagcctcctgagtaactgggattacaggtgcccaccactatgcccaactaatttttgcatttttagtagagatggagtttcaccatgttggccaggctggtcttgaactcctgccctcaggtgatccacctgcgtcggcctcccaaagtgctggtatcataggtgtgagccactgcacccagggatttttactattaatgtgctttaaagatatgttttacctattagctgtaaaaactagccacttgtccctcttacacttatctcttactttt

SEQ ID NO: 265088 - DNA, 212 bp, Homo sapiens
ccagcagctacgccagtgtcgggattgctcagcaagctgcggtgtaaacctggctatcgagtaattagcacccttataaaaacaaaattaaggccgggccgggcacagtggttcacacctgtagtcccagcactttgggaggccaaggcaggaggatcgcttgagtccaggagttcacgaccagcataggcaacacagtgagacctcatctc

SEQ ID NO: 265089 - DNA, 423 bp, Homo sapiens
agttcagttgtaccttttaagcagggaaggacctctggatagtgagttcagtttcctgttgaactttatcctgcccacctttccctctgagctacactcactactggtagcagaacatgatactaagtggaaactttgggttagtggataaaatcgaatggagactgagatgaaagtaaatctgactctcataaaaccagattatcaacagccagtgtcacggtagccctagctgggggtagaattgtgaagggaagcagatgggagtctggttttcctgtatagtggtggcagatcccatctagccaggattagagatgatttatgggtttaaggaattatggcaaactgggtaaaggcaaccaaaaatctaaattgttccgtggtctcccttctttccagtttcaaaaagactggtatgtt

SEQ ID NO: 265090 - DNA, 505 bp, Homo sapiens
gccgctgaatcctgaaatcctgtgattcccacactcggaagctggtgtcgtatattggccacaaagtagttcagatttgattcagaaataggaaatgaatagaaaagacataacaaaagttagtctcgccttatggtaaagtttgttttactgtctgggtcaagttcaaatgagaagctgggctgattggccagcctctgcgacttgatcctgaagatctgctttcttttctaccagaaggctcctaattcttttatctggaataaaaagggaactccgtcttaaagatgctcacgtgaggcggcatattgccagagggtgggcgcaaagactgggggctggagattccattccaaatctgttactgattgatcagaacactttttcaaatccatgcctcagttttagaaaatcctcattagaaacgctaacagtaaaattggtgaatactaaacacttttaagaaccatgaaagcttttgtaaataaagaataaagtgaggagt

SEQ ID NO: 265091 - DNA, 475 bp, Homo sapiens
acctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgcgctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttgga

SEQ ID NO: 265092 - DNA, 238 bp, Homo sapiens
agtgtctgtgggaggtggatagtgtctgtgggaggtggacagtgtctgtgggaggtggatagtgtctgtgggaggtggacagtgtctgtgggaggtggatagtgtctgtgggaggtggacagcgtctgtgggaggtggatagtgtctgtgggaggtggacagtgtctgtgggaggtggacagtgtctgtgggaggtggatagtgtctgtgggaggtggacagcgtctgtgggaggtgg

SEQ ID NO: 265093 - DNA, 205 bp, Homo sapiens
tccacccttctcagtagctgagtgaccaaggagttggagaggaggagtgaaatgaacatgatcactggctgctgatagaacagtaatgagattaatggctcttagagctttctcattaacagtggaaacggtgtgtcagaggcatttacggtattggttctcaagacatcaccccagtacacacagagctaatcacgtgtcccgc

SEQ ID NO: 265094 - DNA, 690 bp, Homo sapiens
acacacacacacacacacacacgtgggaatgtaaggcttattttcttggcacatggatattcaattgcttctttaccatttattgaaaagactgtccattctgcattgaattgcctttgtacctttgtcaaaaatcaattgtctctagaaaaatcaggtttccaggaaaaaaaagactaatgtgttccactagtgttcttatttttcagttgtgttggcttttgtagattctttgcatttccatataaattttagaattagcgtatcaatttcttaaggcttggtgggatttccattgggattgtattgagtctatataaataaataaaactgagagagaattaacattttattttatttttttgagatggagtctcactctgttgcctaggctgtcgtgcggtggtgcgatctcagctcactgcaacctctgcctccgagattcaagcaattctcctgcctcagtctcccaagtagctgggattacaaatgcctgccactacactcagcttaatttttttatttttaatacagacagggtttcaccaagttggccaggctgttctcgagctcttgacttcaagtgatcagccctcctcagcctcccaaagtgctgagattacgggtgtgagcccccgcgcctgactgagaattaacattttaatattgagtgttttgattaaagtcttc

SEQ ID NO: 265095 - DNA, 375 bp, Homo sapiens
gcttgcagaaaatctccctccctctataaaagttaagctttatttttgtttattttaatttttttgagacagagtctcacttttttgcccaggctaaagtgcagtggcacaatttcggcttactgcaacctccacctcttgggttcaagcgattctcacgtctcagcctcccgagtaactgggattacaggcgtgcgccaccacacccagcaaattttttgtatttttagtagagatgggtttcgccatgttggccaggcttgtctctaacccctggcctcaagtaatctgcccccctcggcctcccaaaatgctgggattacaggtatgagccaccacacccggccaagttaaactttttaaatacattttggg

SEQ ID NO: 265096 - DNA, 521 bp, Homo sapiens
  misc_feature (58)..(58): n is a, c, g, or t
  misc_feature (108)..(108): n is a, c, g, or t
tagggaaatgtaaggaattggcttgcaaacagtaatctgtgggacattcgcttgactntagattttgtgtgatcgtaagaagataatttagaaatagattttgttttntagacatgtcagatatactgaaaagatgaataaaaaataggactggttgggcacggtggctcagtggctcatgcctgtaatcccagcactttgggagactgaggcgggtggatcatgaggtcaggctggtcttgaactcctggcctcaagtgatctgcctgcctcagccttccaagttgctgggatcataggcatgagccactgtgcccgcctctatatccatttttaacatttaccaagcactaaaagagatcttatatatgctgaatttttgttggaagttttgtataggcttggaataaacaaatccaaatgttaaaattggaaaatctatttctgtaagattcatagctttttattgtggttgctgtcataatatgattctaagaaaactgttttgagaaaaaaaaaaa

SEQ ID NO: 265097 - DNA, 364 bp, Homo sapiens
taaggaaagagctcttattagttgaaagaaaatgtagattcatgtttccttggagactagtctagtttccaaggatagacggcagtgaggagtcgggtatctagatggaatttctgttggtttggattccagctctgctgcttaccagctttgtgacctcaggcaaacaacttaacctctccaagcctcaatttccccatctatataatggtgatatttataagtttcaccttatagggccacggtggggattccatgaaatagtgtatgtgaagtgcttagcacagtgcctggcacatactcaatgctctatgcatgtcagctagtacttaatgatgctaataaacatgttatgtccctaaaa

SEQ ID NO: 265098 - DNA, 468 bp, Homo sapiens
cagatggtaacaagtgtcagaagcattcaattagcccctgcatttgctcatgatttaacaagctccgtctagtggcatacctgtgatatgtggagctgcagagacgtaagcttctgaaggactctataaaaagctttttgagaatgatgggtttgagtatttcaagttcccagactgccgtaaaaggcaaaggccaggctcccccattcctcttgactgtgtgctcacacagcaaattgagcttccaaaggcaattaattccacaatcctcaattccacaggggatcatgggctgtgcacacagcttcatagaaccactgagccagggggactttgccctatatagaaacccttgtgtttatacaccttggaaatgcttttcaaagccaattcgctcacattgtcatgttggagcctcacaaaatcctgttaagtagaacagttattatcccatttgatgtatttaaa

SEQ ID NO: 265099 - DNA, 2690 bp, Homo sapiens
cgtggagacatgcaccatcctggtctggtgtggacaaggagcagggcagcggggcaggcagggtgaggatggactccttgaacagtcttgcactgaggagagtgttgactgacatatttggactcttctaccttgtctgtcatggtctaatgcatgtcttttctgggtgtggtttcttttctttttttttttttttcttttttcgagactgagtctcacccaggctggagtgcagtggcgtgatcttggctcactgcaacctccacctcccgggttcaagcgattctcctgcctcagcctcccgagtagctgggaccacaggtgtgtgccaatacacccagctaatttgtgtattttttagtagagatgaggtttcagcatgttggccaggctggtctcaaactcctgacctcagatgatctgcctgccttggcctcccacgtgctgggattacaggcgtgagccacgcgcccagcaggatgtggtttcttgaggatcctctcagggctttggcctctcccagctcctatcccactactattagggtcacagaggaggaggtcaagactgggatttacccatgaaggctctttggatgaaatcagctggatattggctgggtcactttgttaaagaccagaacctggggtgggaagcctgtgcctgtttggatgtcagagcccacagccatgggcccctggcccagcttcctaaccagtttggccctgtttgccttggaagcacttgggctgtggggtcaaatggtcccacgcgctgatcttggccttggcgcttgctggctgcatgaacatgagtacatcttgtcacctgtcccagtttcagtctctctattctgggcagaaggattttctcaccgacaaggactaagtaccctcctgtaggctcaggactagggcagagcttgtacacgatagaggagatgctcgatcgggttctctctccaagtcctgcttctcatggatttaaggggctgtggagggcctgactgctgtgctgagttaggcccggggcctgccagtggagttctaaggcctttaaagagtttgagttgtgttttaggaagaccacctggggcagtgtggaaatgtcatgattgagggagagagtttcttgaagcaactccgtctagtgcagagcttctcaagctagggtgcatctaagtatctggaggagctgttaaagcacgtgttgctagatcccactctgagagttttatttttgtttgtttgttttttgagacggagtcttgctcttgttgcttagtcaggagtgcaatggtgcgatctcggttcactgcaacctcagccttcctgggttcaagcaattctcctgcttcagcctccccagtagctgggattacaggtgcctgccaccatgtccggctaatttttattttttctttttgtatttttagtagagatggggtttcaccatgttggccaggctggtctcatactcctggcctcgtgatctgcccacctcggcctcccaaagtgctgggattacaggtgtgagcccagccgagagtttgattttctaacattctcaggggtcgctgttgctgctgccgctaatgttggtaaagtggttagtcagacagatacagggcccttgcccagggtttaaacccttgctgggtttaaactttagatcttctacttgtagctagctatgtggccttggccaggtcctctaacctgtgtgagccttagtttcctcatctgtaaattggaatgctacctgcttcctaggatgttgtaagaatcccatgatttaacgtgtataatccctcagcacagtgcctgtggtcagcatttaatagaggatcgttttattattttattaataccagtgaggaggctgttgctgaagtccaagggagagatgaaagagaggctgaacgaggctcgtggctgagggatggagggcatctgttttctcagtggctcaaagcctatgatcctccctcataggagaacacgttgcttccttccacagcgggaacttgctgaaaacctgtcggctggtgcctgtgtgtcctctagagggcagtggagtcaaggctgaggatggagcattgtgtgccctcggttggggctggtctgtgcgttcagcctttattccctgttctgaaacccaattgtgtatttgcattggactgtcccctcctccttgctctgtgtacttgctgacgctttttggaaaacacatcacagggcacctctgatttcctgcttgtcttgtagcctgggattagcagtagctgaagcgtgctgctttctggcagttgtgtttatttctcaagggcacaggctgtacagatcatgggggcctgctccctgcagctcagctgagcctaggatgaaccacagttgctcttatgccagttaaaaacttggggcctgttccatcttgcatttcctcccccgcttcccagtcctcgcccgcaccctttgatcctgtgagtggagaaatgaagagaactccaaatccttaatccattttgaaggccggctggcagcagggctttctgtgggcctggtaagcagccctagttgaatcattttagagaagggcaggtattctttcaaggttatagaaagaaagaaaaaaaaaaaaccagaagcacatttataatattggacagtataccttgtcccaagccctgt

SEQ ID NO: 265100 - DNA, 1852 bp, Homo sapiens
cgtggagacatgcaccatcctggtctggtgtggacaaggagcagggcagcggggcaggcagggtgaggatggactccttgaacagtcttgcactgaggagagtgttgactgacatatttggactcttctaccttgtctgtcatggtctaatgcatgtcttttctgggtgtggtttcttttctttttttttttttttcttttttcgagactgagtctcacccaggctggagtgcagtggcgtgatcttggctcactgcaacctccacctcccgggttcaagcgattctcctgcctcagcctcccgagtagctgggaccacaggtgtgtgccaatacacccagctaatttgtgtattttttagtagagatgaggtttcagcatgttggccaggctggtctcaaactcctgacctcagatgatctgcctgccttggcctcccacgtgctgggattacaggcgtgagccacgcgcccagcaggatgtggtttcttgaggatcctctcagggctttggcctctcccagctcctatcccactactattagggtcacagaggaggaggtcaagactgggatttacccatgaaggctctttggatgaaatcagctggatattggctgggtcactttgttaaagaccagaacctggggtgggaagcctgtgcctgtttggatgtcagagcccacagccatgggcccctggcccagcttcctaaccagtttggccctgtttgccttggaagcacttgggctgtggggtcaaatggtcccacgcgctgatcttggccttggcgcttgctggctgcatgaacatgagtacatcttgtcacctgtcccagtttcagtctctctattctgggcagaaggattttctcaccgacaaggactaagtaccctcctgtaggctcaggactagggcagagcttgtacacgatagaggagatgctcgatcgggttctctctccaagtcctgcttctcatggatttaaggggctgtggagggcctgactgctgtgctgagttaggcccggggcctgccagtggagttctaaggcctttaaagagtttgagttgtgttttaggaagaccacctggggcagtgtggaaatgtcatgattgagggagagagtttcttgaagcaactccgtctagtgcagagcttctcaagctagggtgcatctaagtatctggaggagctgttaaagcacgtgttgctagatcccactctgagagttttatttttgtttgtttgttttttgagacggagtcttgctcttgttgcttagtcaggagtgcaatggtgcgatctcggttcactgcaacctcagccttcctgggttcaagcaattctcctgcttcagcctccccagtagctgggattacaggtgcctgccaccatgtccggctaatttttattttttctttttgtatttttagtagagatggggtttcaccatgttggccaggctggtctcatactcctggcctcgtgatctgcccacctcggcctcccaaagtgctgggattacaggtgtgagcccagccgagagtttgattttctaacattctcaggggtcgctgttgctgctgccgctaatgttggtaaagtggttagtcagacagatacagggcccttgcccagggtttaaacccttgctgggtttaaactttagatcttctacttgtagctagctatgtggccttggccaggtcctctaacctgtgtgagccttagtttcctcatctgtaaattggaatgctacctgcttcctaggatgttgtaagaatcccatgatttaacgtgtataatccctcagtccctctcccctccgagcacgatgctcgcaccgtatc

SEQ ID NO: 265101 - DNA, 594 bp, Homo sapiens
tcccagggattcatgaggtatttgagaaaaatacagactgaagatgattggctaaccatctagaaagaggggaacaaggaatccctagttcctttatcttccaagcaaatagccaaagtatgtgagggagagaagaagaggcatcccccttctttctcccattttatatccccaagtcctggtgacctcagtagggtgctgcccatggatgccaacacagctttcacccatgttaacagtgaggcctaaggggtgggagttatccatatttgcccatgcactgcctcttccctgctgtgagtaacttttgagttcctagatcttgtctatgccatgcatgcaagtataaccttcaaccatgaagtgggagggcctatccagtaagaattagtcatgctcacctgcgttgtgccccatcttctgttgttgcctccctctgcatcccttagatccagttttccctcttatggtttcaacccaaagcctggaattgagtttgggacaaaagcgtacctcaggggatacatgaattaatttagattatgtcacagatggctgtcaccaaatttgcagccagcagcctatggggtcact

SEQ ID NO: 265102 - DNA, 1516 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctggcgacaagggagaggcaggcaccaatggaaagagaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgtgagtgtggggctgggcagaggcggtcagcctgggagtcccggaggccaggctgcacacctggtgggagaacacactctggaattctctattctcctggtcggggacagtcagagatgatgggggagatgaccggtgggtaaaagtccaggcctttgggggaggctgggagaggttgggtgctctcctgctgtgtggcttggggcttgttgcctcccctctctgagcccccatttcctccttcatcctgtggagtcttgtgaggagaacaggttggcctcctggtcaaccccacctgtgatctctgccaactacaaatgctgccctctggagagcggtcccccgtgctgtggaacgtcggcctggcccccccggctcctgtcccctggcttctccacaggttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggtttgggagcttggccctacggtttgtaaaagaaacacatgtcgtgattctaaattgggtttgtcttgctgtgcggaagaggttcaaatccagctctgtttccgcaatc

SEQ ID NO: 265103 - DNA, 1002 bp, Homo sapiens
accagaagagatggagctggacagagctgtgggggtcctgggcgctgccaccctgctgctctctttcctgggcatggcctgggctctccaggcggcagacacctgtccaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggtttgggagcttggccctacggtttgtaaaagaaacacatgtcgtgattctaaattgggtttgtcttgctgtgcggaagaggttcaaatccagctctgtttccgcaatc

SEQ ID NO: 265104 - DNA, 603 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctggcgacaagggagaggcaggcaccaatggaaagagaggagaacgtggcccccctggacctcctgggaaggcaggaccacctgggcccaacggagcacctggggagccccagccgtgcctgacaggtgactgaccacccccacactcctcccacggcttgtggctgcccttggctggaagtccagggtcatacgacgccattgccagaatgaagtgacaaatatgaacagaagaaaatggttgcttgcccgtttccttgtcccctaattattcaaggaagtgacaaatattgtccagacaacttacatacactccatggcaatttttttctatttataatctacgccagaaggccccttgcaggctgtaaccctttataaaaaaataaaatctcctttttaaatttaaaaaaaaaca

SEQ ID NO: 265105 - DNA, 1116 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctggcgacaagggagaggcaggcaccaatggaaagagaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggtttgggagcttggccctacggtttgtaaaagaaacacatgtcgtgattctaaattgggtttgtcttgctgtgcggaagaggttcaaatccagctctgtttccgcaatc

SEQ ID NO: 265106 - DNA, 1980 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctggcgacaagggagaggcaggcaccaatggaaagagaggagaacgtggcccccctggacctcctgggaaggcaggaccacctgggcccaacggagcacctggggagccccagccgtgcctgacaggtgactgaccacccccacactcctcccacggcttgtggctgcccttggctggaagtccagggtcatacgacgccattgccagaatgaagtgacaaatatgaacagaagaaaatggttgcttgcccgtttccttgtcccctaattattcaaggaagtgacaaatattgtccagacaacttacatacactccatggcaatttttttctatttataatctacgccagaaggccgggtgcccaggagctgaaggtgggggtgacactgggaggtgggagggccaggccaactggctgcggccatcacagctgcgtgcctgggggccgtgtccctgtccaggcctcagagtcccgctctgttcatacagacgcctatggccctgcttcttcctcccaggcctccctcctactgcctgtgccctgcccagggctcctgtcctgcagccattccccgggttcccttcccaggcccgcgtacctgcaaggacctgctagaccgagggcacttcctgagcggctggcacaccatctacctgcccgactgccggcccctgactgtgctctgtgacatggacacggacggagggggctggaccgtgagtgtggggctgggcagaggcggtcagcctgggagtcccggaggccaggctgcacacctggtgggagaacacactctggaattctctattctcctggtcggggacagtcagagatgatgggggagatgaccggtgggtaaaagtccaggcctttgggggaggctgggagaggttgggtgctctcctgctgtgtggcttggggcttgttgcctcccctctctgagcccccatttcctccttcatcctgtggagtcttgtgaggagaacaggttggcctcctggtcaaccccacctgtgatctctgccaactacaaatgctgccctctggagagcggtcccccgtgctgtggaacgtcggcctggcccccccggctcctgtcccctggcttctccacaggttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggtttgggagcttggccctacggtttgtaaaagaaacacatgtcgtgattctaaattgggtttgtcttgctgtgcggaagaggttcaaatccagctctgtttccgcaatc

SEQ ID NO: 265107 - DNA, 282 bp, Homo sapiens
cttgcccaggctggtctcaaactccttgccccaagtgatcctcccaccttggcctcccaaagagctgggattacaggcatgagccaccgctcctggccaacggtgtcctatcttatctcacaaccctattcctggagaatctggcatagggagttggagctatggctcagggacactgaccttggagacttgaaccctggtctgaggtctgcagggaaattttcaaagggaaaatgtctgagtacttgtttcagaaacttccagaggcagaaagcaggagac

SEQ ID NO: 265108 - DNA, 406 bp, Homo sapiens
agcagacaccaatggtcagtgcttctactttggatcaaaaagagagaactccaataggcttagggtgggtcaggtgctcacactcatctgaggaaggggagggtcccttgaggaatagtaccatagactacccaatgttggaggataatggccccaacgcaaaaatgggatcttgccaccagacaaatgggatatagatgccaggctgcaaaatccaacaaatgtacacgtgcccaaatcccgactccatcactaatagccatgcaatcctctgactatcaattagattaattgacactcttttttctctcgctactgtggtacatgcagtagttacctttattcttcactttgttttctcataagactaacaagcagttttttaaaataaagaaataaaagcaaa

SEQ ID NO: 265109 - DNA, 613 bp, Homo sapiens
gatattgtatacaaatttagtaaacatgccatcagtttcatcctcatcactgatacaaagtttgaacagggccgggcacgctggttcacacctgtaatcccagcactttgggaggccgaggagggcgaatcacgaggtaaggagatcgagaccatcctggctaacacggtgaaaccccgtctctactaaaaagtacaaaaaattagttgggtgtggtggtgggcgcctgtagtcccagctactcaggaggctgaggcaggagaatggcgtgaacctgggaggcggagcttgcagtgagccgagatggtgccactgcactccagcctgggtgacagagtgagactccgtctcaaaaaaaaaaaaaataatccctgtcatttcttctttcctattctaagaaattttatcaagagcagaaattcagatgaaccatgtccactctcttctcctaatccagcagtataaacagtctatgaaaaaaagtgaaatgaacttggcaggacagaggagcctttaaagaacccactctgtgttcaaagaccctgttgttcctttctaagaaccccaaatgatttttaaatctgttttaaaatttttttatactgtttaaaaa

SEQ ID NO: 265110 - DNA, 414 bp, Homo sapiens
cttgatctgaatgatacttatatttatgtgctaatttttctctaaattaatcatatacttatgacatgcataataaagtcaaaatattttaaggtcaaattaataaagggaatgtcctaaatgaagatattctgtctgtgaacaattatatagttatatgagagaacttgctgggcataatagctgtaactttaatctttattaaatattattaaataataagtcattgttaaatctattaaatagatttcttaaattgtccctaatttttcatgagggcggtctgtatccattagccaggtgcctgagtttagctaattttggttttgggcaggagttgggaaagtcagactgttatctgactgattgttcatggactttaaaattagtcttacacataccccaagatttaaa

SEQ ID NO: 265111 - DNA, 1055 bp, Homo sapiens
gtacgtctatgagagggaataatgtggatggatggaagtggagtagaaactacccctttgcctgtgagccccctgtcccgtcctttttcactcacataccagtcaccataccttcagtatccatcctacttcctttatagctgtttcacttggaaactaatgtgtgggagcacctcctgcagcaaactgctcttgaatcttaattcgatgagtcagtgactcttaaataccgattaagccttcaccctctcccccctcccccttttaaacttatgacctgtaagattcttgtaaaaaatagggttagggaaacatttttagaatttaataggattaaggacacctggagtgtgggcgatgttgagctagagtttacctttgtgaatattggacgtgtcttcaggaacggagaagaattttgaatgctaatttttacctttcagctatgtgaaaacacatgatttacgttgatgtaaccgaatttacattgctgaatatgttggtgatttcattaacttttagagcattccggtttaagttttagcttatttgggctttctccttgctttccaaacgaaatacttcgtcttttaaatgttttgctttaacgtgacagctgcgtggagaaataatggttggcaacacttttctattgagaagggatttaattccaagcagaatattagcatccgttttcttgtaattaagttcaacttttgtttatcttcggagggttggaaagagttaagtgagttaggacttagtcatttggatgcattcctttaaatacagtgcattactaaagtcagacctttttgaaataactttttaaagtctgtaccgagtcctgtttaacgtaaaatagctagagaaaggccaaacaacatttcctcctcccttactccctccccaccccaaaacacacgcttctgctgagcgggtgtagaaggaggtacattgctgcagtgtcagtgcagtgtagaagcagaagtggcagccatgttctgtctctttttgtgaatcgccctcatttgcatagcacactcttcattcat

SEQ ID NO: 265112 - DNA, 596 bp, Homo sapiens
agtgtattctttgagatcagctcagtccatttctagccaataaggttagcctcttcaagaggacagattagttttgagtctgtatgtatttaattctaacttggactgattccacttccagctttatgtgctctttgccctgtctccttaaaattatcaagaataatttgagtatcaggggcaaatgtcatgagatatcgctggctgcagaaccatctaatgacagccttatctaaaacacttgcactatgaaaaatgttctttttattttgatccatagacattctagcccttggcaaacctagaactgggctcatcacatttgctagcctcctacttatcttggttttcagattactctcagtccctgggtcaaattcacactttgtcactgttgtctatttcactgcctaacctaggtcaccatccatcaactctagcaagtgagacaatatcaagagttgtgattattgatgctcttttaccgctctgccccatttgatgtttgtatatttgatagaatacagtgcatacctagttggtatagtgatggggactgtttccatggttaggtacattttgtgccctgctttctg

SEQ ID NO: 265113 - DNA, 633 bp, Homo sapiens
agtgtattctttgagatcagctcagtccatttctagccaataaggttagcctcttcaagaggacagattagttttgagtctgtatgtatttaattctaacttggactgattccacttccagctttatgtgctctttgccctgtctccttaaaattatcaagaataatttgagtatcaggggcaaatgtcatgagatatcgctggctgcagaaccatctaatgacagccttatctaaaacacttgcactatgaaaaatgttctttttattttgatccatagacattctagcccttggcaaacctagaactgggctcatcacatttgctagcctcctacttatcttggttttcagattactctcagtccctgggtcaaattcacactttgtcactgttgtctatttcactgcctaacctaggtcaccatccatcaactctagcaagtgagacaatatcaagagttgtgattattgatgctcttttaccgctctgccccatttgatgtttgtatatttgatagaatacagtgcatacctagttggtatagtgatggggactgaaaagccctccaactctgagtctggctttttttcatgattgatttggggatttgtttccatgaagtagggtaca

SEQ ID NO: 265114 - DNA, 394 bp, Homo sapiens
tttttatcccttgcatcatcaaatagtgatctttttggaaatgggaataatgtatttcttgtatacctgctgcttgcttccacagtgtctcaaatatgtatgctccagggctgggcacagtggtttgctcacaactgtaatcttagcatttggagaggctgaggtgggaggatcgcttgagaccaggagttcaagaccagcctgggcaacatagtgagacctcatctctacaaaaaattaaaaaataaccaggcatggtggctcacacccatagtcccagctacttgagagtctgaggcaggaggattgcttgaacccaggagttggaggttgcagtgagctatgattgcaccactgcactgcagcctgaggaacagagcaagaccctgtctca

SEQ ID NO: 265115 - DNA, 352 bp, Homo sapiens
ggaaacccataatcatggtttcaagtgggcagagaactaggctctggcgtcaggggaggaaggggaactgttcactgtcaacaccttttaggacgtttccattgggatcgaagggtggctcactctgccactttgacataagaatcacttctacctaaggcacttgaaaaatggcacaggcaagagcatcatcggatctctccttttcttcctgaagacaggagataaaaacgctcaggtgaaagatgccttccctgtaccgggcgaagaaagattcctctacagggaagcacgtcatagccaacagaattctgtacagacattaaagtaattaaagtaattcctgtcgttc

SEQ ID NO: 265116 - DNA, 266 bp, Homo sapiens
  misc_feature (230)..(231): n is a, c, g, or t
  misc_feature (233)..(233): n is a, c, g, or t
  misc_feature (263)..(263): n is a, c, g, or t
aggtgccccggacaggtgtggccagcacgtcttgccaagaccccaccaccccacccacccgcatctgtggccttctggaaccgagctgtggcctggggttccatggagcaggtggggcgcggaggaactgagctgtggcctggggttccgtggagcagaaagttggccggacgtggtgcgggcgcctgtggtcccaggtactcgggaggctgaggcgggagaatggcgtnnanccgggggcggagcctgcagtgagccgggantgc

SEQ ID NO: 265117 - DNA, 408 bp, Homo sapiens
aaatgaactagttagaaaatagcatactaattaaacctcatctctcactttcaaaccatgttaatgttgtctgcaggatctttatttgtaagacaaccaatttagttacttgctttcttaaaagttcagaatcctccacattcactctcatttctgtttgaaccctacgctgtcagattagcaaaagacagcttgcagaaattaaatatatttttgttagcaaaaattagcttgcaaaaatatacacatgagttttagtccacaaattgtcaaataacttagaagtcatctggaaaacatataatgtccttaagcaggtttcctgtatttagctaataccagtgcttaaaagacatgcaggatcacagttagcatttcaattttcagttgtattttctaactctggat

SEQ ID NO: 265118 - DNA, 676 bp, Homo sapiens
gcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttatgctgaacaataatagagaaaggccatggttttacatttctctgagacatcactgccaacaaactgaatatgtttttcattatactttttccttggctatatttattcatttatttatttattttgg

SEQ ID NO: 265119 - DNA, 327 bp, Homo sapiens
gaccttattgcctttgtgatgacaggccggtattggacaggctgtccctcaatctgggtttatctaacgtttctcaagggtcaacgcaggctgtgcgtgttgggtaggcctgttactgtgggctcatccccgcgcttcttgtcgggaggcacagggttttgactgtcccattgctgatgctcactttgatcacgtgaggaaggtggtatctgccagccttctctccactgtaaatttattctttttctgtttgtaattaataactatgtgggaaggtattacgagactgtgtaaatatcccattcctcattaaattttcaatttatt

SEQ ID NO: 265120 - DNA, 356 bp, Homo sapiens
gttactgtgttgattatacttaattggttacctttcaatagattgtttacctgcttatatacttctttgcatgtctagattgctcaggaaattatattcttttctaattaagaattttctagtctattctgtttcaactcttcctaaaagtctttctaaaataaatttacacccatttctgcccctttgtaagtcagactctctttgatatgttaggattttgcagtgctgtgggcttttcttaagttctcattgaagtgtttagatttgggtgggaggttgggcttcatgtatactctatattggaaattgctgttcggactaaataacttttcttgttaatgagatctttctca

SEQ ID NO: 265121 - DNA, 424 bp, Homo sapiens
catgatgcctggcaattcactccccaaggagaaactagacctacccacacatatagattctaaagggggaaaaaggaatcacaataataaacaagaatcctgctatttagaaaaatgaatatatatctcaaaaaatccttacatgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtc

SEQ ID NO: 265122 - DNA, 989 bp, Homo sapiens
agcggaaagaatgaaacttccttactgttcactaacctacgtctcaattacctcccaacatgtttgcagcaagtaccctgtcgatggtaggcaagaggaaggtgtgacccacaaagatcaaggaatctaagccggccaaggttaagcatgaatcgaggaaaggaaacagaaatcctcttcctagtcctctttcctctgttttctcctctgggtaccagaattgcgacagagtgggacagctcaggcagctgcaggtcttggccagtgctcttcctcacccaggccatgcagcatcaacacagtcaccgtagaactcctcttaagacaagcaaaggaactttccaacccagttgagtgcacttttcccaagtgtgtggtaaaaagttaaatgacactttgtgaaagggatccttaagctacaaaaacattttcccccatcacactaagcacttggttttgtccttgtagttgcaaaaggggctggagtcatttgatgaattctgaatgttgtaaggctgcttttctggaagggtaaacagggaaccttttagatgccaagaccttttagaataacgacccttcagaggaaactgaagtgcaaaggattgaagtaaccttccagaaggtacacagctggtgagacaaagcctggactgggtcccaagcctgcctgactccggactccacaccccacagtgataccagaatcaccctgaaaatgggaaacacgctgcagctgctgtcctgattccagcctctgaccaggagagctggattgaccaggaagccaatgaagctaagtttcagggccccctgtctgcctaaggcctctcccaaggccctgcaccaaagtttctatttgtgactttgttttcttagaaaaaactcctcaattatgtgaattcacctctgctgacaagtaactccttagaggacgtgagttttagaaggacaagctccaaaagcatctctagatagcctccagaacc

SEQ ID NO: 265123 - DNA, 582 bp, Homo sapiens
catgccgttcttagtagtgtgatgaaatctcgcgccacccagctccatcctgcccgggatgtgaatcatccttttgtccatcgtattcctgctgtagacatgactcaacccacccatcacttagcagccgtctgggttatcagattgactgtcatagcggcacagtgcttgtgttcaagcaacccttattttacttcccgatggccccaaagtgcaagagtagcgacgctggtgattccgacatgccagaaagaggctgcaaagtgcttcctgtaagcgaaaagctgaaagttctcaatgtaataaggaaagaaaaagaaatcatatgctgaggttgctaagatctatggtactcagggagttttgagattttccaagatgccatcgaggaactgaaaagtgctgcccagctgcagtgagggctttttaaaggcagtttcatgtctacaccccactgagttcagactgtccaatgaagcactgacattgttacacatgcgtgttgtggacaacttgagaaaacacttgtctgcaggaagatgaaattaaaatcaagtgtgatcctaccaccgaaagataagt

SEQ ID NO: 265124 - DNA, 582 bp, Homo sapiens
agcggaaagaatgaaacttccttactgttcactaacctacgtctcaattacctcccaacatgtttgcagcaagtaccctgtcgatggtaggcaagaggaaggtgtgacccacaaagatcaaggaatctaagccggccaaggttaagcatgaatcgaggaaaggaaacagaaatcctcttcctagtcctctttcctctgttttctcctctgggtaccagaattgcgacagagtgggacagctcaggcagctgcaggtcttggccagtgctcttcctcacccaggccatgcagcatcaacacagtcaccgtagaactcctcttaagacaagcaaaggaactttccaacccagtactcagggagttttgagattttccaagatgccatcgaggaactgaaaagtgctgcccagctgcagtgagggctttttaaaggcagtttcatgtctacaccccactgagttcagactgtccaatgaagcactgacattgttacacatgcgtgttgtggacaacttgagaaaacacttgtctgcaggaagatgaaattaaaatcaagtgtgatcctaccaccgaaagataagt

SEQ ID NO: 265125 - DNA, 476 bp, Homo sapiens
ctttccaggtaatcacggcctggacaacctgctggggaaggcccacctaactgattctgccaattttgacaatgtggacccatctttcatcaggacagagcacaatgacttgggatggaaatgccttatattttagcaaatttgatgtataaatgcttggaatttacacttgagaagctgaggggtggtggttatcgacaggaatctgtcagagagcatacccatggagcatttataattgggagccattccagaattctggtttgcatacaactctttaaaaagccagctaccctgaaatgtacactatctgagctctgcctttgcctgtgatgagtgatgttggtcctgcctcttagttctgctctcagtctccaccatcggcttctcagattttccttccaggaccagcaggcaggtgggtgtggtgactttgtggcagacactgtggcagattaaaggtggttgcaaattgt

SEQ ID NO: 265126 - DNA, 281 bp, Homo sapiens
ctagaaggtgcaaatgtgtgaatggccactgtgaagagccggtggaccctgccacgtgcctttttcccctcccatcaacctcttttgtgcttccccctccatgtaccaccttctccataaccacccctggcctcacaactctctcctttggcactatcgtctccttttttttgtttgtttttttggagtagatgaggtctccttatgttgcccaggctggtctcaaactcctgggctttttcctgctttttggctgccttctcttccatcgtttccatttg

SEQ ID NO: 265127 - DNA, 416 bp, Homo sapiens
ggaactgttacaacatgttggtaatataaaggaaaaaggaaggtatctcacatttagtgagaacttattatgtgtcaggtgcaagagctattaagattcacgagatataatttctctccttacaaaatttcttgccatgggacaaagagacaagtaactcaccagttatttgatcatttcattaatatagtgatgacaaagaaagtaaaattcaaggggagggagtattgtcaaagagttctcctcatttagataccttcctttttcctttatattaccaacatgttgtaacagttccagggtcacaccaaataattataagtctacagccctttgcctagttacacaaaatatgaatgacatccattatccctggaaaataattggttaactgaaacattaccacaaataaaggt

SEQ ID NO: 265128 - DNA, 434 bp, Homo sapiens
attaccaaggcatcagggcagagactcccctgaggctatgctagaagggtaccatttgaaaaggaagtgtatgacccaccgtgaaatggaactggtagctggtcacccaggtgctcttccttgttaactgatgagagcgattattatgtgagaactttaacaacctgccaaaggatcccggggcaagaatgagagctgaaccattgaaaagctgagcatcgaagtgcctgggaagcccaaaactcagcacattcatgcttttgctggtttttgaccattgagaagaaaaaagagtcagcaaccagggagcaggatgagtggatctggttcagaacatctgtgaacacagagggagtggaaacttcactttcaacatcatcagccaacttccctcccattacaattctatctcaagatcaaggtcatgcaacaaa

SEQ ID NO: 265129 - DNA, 828 bp, Homo sapiens
tcaggattttggtttgtgagtgctatccagccactggtgctagtacaaaactttatcacattaacttgctttatttaattctgtgttattttcaacatcattatccaataataaaatatgacttcatcaatttatctttcaaatcaagttgctcacatcatttcagatatatattacaatccaatagctcccaattatttttaaaaacttattcataaacatgggataaacctataaagactgctgtttcttcatgagataataatatgatataaaaacaaaacttcaaaatatgtttccaaaatcacaaagaataaaatatatcaatttgtaggtaaatgagctcccccaaattttatgatgatagcacacatttttcttgattaagaaaattctgtatatgttttcctctttccgaatataaacaggctatgctagaagggtaccatttgaaaaggaagtgtatgacccaccgtgaaatggaactggtagctggtcacccaggtgctcttccttgttaactgatgagagcgattattatgtgagaactttaacaacctgccaaaggatcccggggcaagaatgagagctgaaccattgaaaagctgagcatcgaagtgcctgggaagcccaaaactcagcacattcatgcttttgctggtttttgaccattgagaagaaaaaagagtcagcaaccagggagcaggatgagtggatctggttcagaacatctgtgaacacagagggagtggaaacttcactttcaacatcatcagccaacttccctcccattacaattctatctcaagatcaaggtcatgcaacaaa

SEQ ID NO: 265130 - DNA, 432 bp, Homo sapiens
ctccttgattaaattaaatgaacatcctttcctgttactccaaaggattccttataatttttttatagcacctttgattttagactgagggcttttagatagacttaaatagattcttctactgtatgtttctgaaatattggcccctgtactttaccaacatacatttcactttataaagttaatgtaagggcttttcagtgactccaggcaaacctcaaacaatctctgatttgcaaaaagatcaagatgcctctggaaataacacacaacccagtgttgttattattatttttttgcaagacctaactagagaagtgatcattatactgtatattctttaatcttgatgtttttaaagaagtttaagtgttgtatcctttaagcaattaagttcagttcaaaagacagaataaatacaaagctctttaa

SEQ ID NO: 265131 - DNA, 687 bp, Homo sapiens
gggattacaggcatgagccactgtgcctggcctgctttagaggtttgtttatttatttatttatttatttatttatttatttatttattttgcatattctgaagatacagaatatggcaagcacattttaggtactcaagtaaaattcagcacatttcagaaagaatactatgtaaatgattatctagggactggattactgctctacaataaagtaaacacaccaccaatacacaataacaaaggtcataccaaaatcttatgctgaataatacaagttaggcatgaagtaaaacatgctcaatgatactatctatatagaaatcctagaaaagacaaaaagctcaaatacagtaccagaaagctgatcagtatttgcgcaggagctgggagaaggggcatgagaacattttgaaattatggaaatgttttatttcttgattgacatgtggttatatggatatgaatattcattagaatgtcccctcactctacacttagtataggtacatttaattataaaatataattctatgaagctaatcaaatggctgttaaagaaagttttggtactgaaataaacctattaacaaattggaagttcctttttcttcctttctttgttttaatgcaactccttaactatgccaaaaaatggaaaccctcctgaatatggtaaaatgttta

SEQ ID NO: 265132 - DNA, 314 bp, Homo sapiens
ttgtttttgtttttgtttttttgaatggaaagcctctttagtaataacaattataaaccacattgtaagaagtaaatagaagaaagttagaagtttcctagtaaaacaaggttttagaatgcatttgataaatacagcttctttgttggtgatttctgttttacctttgttttttgatgtgtttttagttctttcagtggtctctacagcatttctatatatgtttatcaccttatttcttgagtatataacttacataccatctgttatctttcaatatgatagatatgtattttgctcagttatcattacta

SEQ ID NO: 265133 - DNA, 299 bp, Homo sapiens
ggcaggaggcccagtcagaaacaccgagggcagaactgtcccgggaagtcacctcagtcacacgaaagccaccgtgaacaggagcttagctacagacgatgggaacgaggtgatcaacactgcaggagaaactggtgcacggcggtgactgactggggatttggcataaggacaactgccttttaaaggctgggagaggccagcgcagtggctcatgcctgtaatctcaacacttagggaggccgaggcacaccgatcacctgaggtcaggagtttgagagcagcctggccgacacggc

SEQ ID NO: 265134 - DNA, 235 bp, Homo sapiens
cctacagcttgagggatctgggtcagtgatagagaatggagagaaagtatagggaaaatgagatttgaaagcctgctggagagaagtctgacattttagctgttacatgaatatatctcccagcctctataaacaagggcatgctggttagggccacctgtacttagagccagttatggtttgcataagcatttcataggatgccatcctggggaaatcctcatggggagcccca

SEQ ID NO: 265135 - DNA, 482 bp, Homo sapiens
ctgctaagaacagctttggcactatgagatgttaactgctgttctctttggattcatctgcgttgcactctttattaatggctgtgggtaacgggattaggcatgtacaggattgagggacatgggcaattccccccctaccttcaagacagcaccctcagccgcctaaacttttcagtgttcctgcaatggtaggtcttcctctggcctccctgagcatttcgccttgcccaccctgccacggacagtgctttttattcgctcctttccctttcttatctctctgttactcagggcaaccatgttgctcagagaccacgtgtcgaaactcttaagtcagaggttggattaaagatgacggggctcacccatctgggggcaaatttaagctttgccaatttgatattgggtgctaagcagagtggctaatgtctgtgttttatcacttgtattttgctctggccagaacgaaaaaaaaataa

SEQ ID NO: 265136 - DNA, 528 bp, Homo sapiens
ctttcattctgcagcagcctgcctcgctctctgactgatgtgctctgccaggagctctgtgttcctggccacaaggctgactcatcccgctgttgttcctaaccgtgcctgtcctatatgtctaggttgaggattggggatacagacaaagggaaggataggtcaaaatgaacgaccaggggactaggcgatggttgggtactgataagttccaagttggggccccaagttggcaaggggtgatactggtttctgcagaaagaaacagacttattgtcctaaggttgatagcaaaggcttgtgtgaatgttcagttccatagtctgacaaccacacagagtttgggtacatttgtgtttcgagatttatattttgcgttgacttcgtgatttatgtctaaatataaggcccacttgcattattcagtaggaaaagatatataagaaaaattgaagagctctgtatcattctgagaaatgggtaaataattcccaaataaataaagttgatgtgggtgagcaattttta

SEQ ID NO: 265137 - DNA, 476 bp, Homo sapiens
actgtctgttactttaagtggttttttatctagcaacagctagctgatacacagacataacaatttgcatttccctatggcttggtaagtatcttctacctttgttggtacaattaggccaacaaggattaaaatcaacaaagaatgtgtacatggatgttatccttactgctatgaatatcaaactattgcttgaggattgaggtccagtaataaaacagcagctatttctccaaaaaaatcctctgtgacttttcaaatgaaatgagggctttcctgccaatcccacaagtcaggaagataaaattgggcatggatctttcccttgctgctgcagaaactcttcatccctgtcagagatggcagatccattgctacaaccagggggccgtgctgaaagttcagagctggttttggaaatgacacagtctacttcattctggataagggcacagtctgtcataacaggttatttt

SEQ ID NO: 265138 - DNA, 206 bp, Homo sapiens
ccactctctacacagggcccaggttctaggccaagtggggtccctcttgtccagaattctctcctctgtcccctctccgcaagcagggacagaaaggggaagtgacaaaaacatacagttgcccataccctgccctccatctctcctcgccctccaagcagacgaaaagcatcagtgccttgctgcccggactgccttgagccttc

SEQ ID NO: 265139 - DNA, 343 bp, Homo sapiens
acatcttttcatgtgtttcttttgccatacatgtctttgttagtgaagagtcttttcgaatccttagcccgttttttaaattgaattgagtaaaaaaaatattgtgtttcgagacttttgggtttttttgttttgtttcttttaagacggagtctcactctgttgcccaggccagaatgcaatggtgcaatcttggctcgctgcaacctccgcctcccaggttcaagcaattctcctgcctcagcctccagagtagctgggactacaggtgtgcgccaccacgcccggctgatttttgtatttttagtagtgacagggtttcgccctgttggccaggctggtc

SEQ ID NO: 265140 - DNA, 464 bp, Homo sapiens
tttttgatatgacaccaaaagcacaggcaataaaagaaaaaagtgagatacagcaaaatttaaatgtgtgcaacgaagaacacaatcaagagtgaaaaggcaatctaaagaatgaaagagagtatttgcaaatcatatagctgataaagcattaacatgagtacacaaagcactcctacaactcacaccaaacaacccaatataaaactgggcaaatgacttgaatagacatttctccaaggaagatatataaatggtcaaaaagtacattaaaagatgctctacatcactatcattagggaaatgcaaactaaaatcacaagataccacctcacatcacttaggatggctaccatcaaaaaataaaaataacaagtgttagcaagcatatggagaaattggaactcttgtgtactattggtgggaatataaaattgtgtagccccttatggaaagtgtatgta

SEQ ID NO: 265141 - DNA, 489 bp, Homo sapiens
atgaaggaaaaggactggcctggggtcacagagctggactctccagtgagacagagcagcctcttcccaaccccactggaaacacggagccctagtgtccacttagcactctctgctcaccccagccttactgtgatctctcccctctgctcccgtctgccccagccgcaaggcctcgggtctaccgtggaatgaggggatccctaggcccagggaagggaggcgcgcttaggggtgggggcacaaacgggcatctcggtggcacttgtcctctctctaccctgggaaagggcagaaagcggcagccaagtcagggctgtgcacgggagagagagtgaccgcggcgggggcgcggagaaccccgctgggctcccgctcggtgagagggcgggagccgtgggtccgcgaagccccttcctcccccgcacctctccccgcagcgggggcgccccgccccccgggcgcccgacgtggaccggccgccgccac

SEQ ID NO: 265142 - DNA, 469 bp, Homo sapiens
gtagttataaattcctggaagatgaaaaccaaaatttaaaccaataactttttctccatcctggaagttttttctaggaaatatacaagaattgatgagggagaaaatgtttatccattgaatctcaacaggaggagtttcatatttgttgctaagaggaattatttttgaaatatttcaattagctttttaacaaaaaagaatgaggacccttgatgagatctacaaatagagtataagtgggggaaaaaatcaaggtccaaagaatgtaaattatataaccgttagtgtaaaaaagagggagaaagtggaaacgtctaagtccttgtttcttatccatggaattgatctggaaggatggacaggaaactgataccagtggaaaactgtgaagagaaaaacttaggctggagcacagaagaatggggagagcccacatgatgctcttcagttttcgttaaaaaaataa

SEQ ID NO: 265143 - DNA, 581 bp, Homo sapiens
atcatttacctttctttttttaaatcattaattttttaaacagccttgatgtgtttttataaattgtagactgtgaatttttgtgctgtttgaaatctaagagagagttgcctttctttgtattcttggagcaaagtagaaagtgaacccatgactagaaagataatatcaagtaggatattgtaaacacacctcagggagataacatggggtggaggcagacaaacaggccaatccgggggaggaatggagttaaggaaagctctacaatgaggcagattttttaatacccactccttccaagtccttcagctcaagctgcagccaaatatttgcataaagagctggtaaaggattccagcttcctggttcatgacattacagcatggatcgttttcaaaattaatactgcctcctgtttcagcagtggctgcctgcacagctctccctgtggctcagagtatgggagtgagtatgccctgtaacccaaaagaggtgtggtgagctcggcttcccagcacagaatcacagagcaatacgggtacctttaaactttaaagccacacctgaaatttaaaaaa

SEQ ID NO: 265144 - DNA, 462 bp, Homo sapiens
ttaagtttcttagataatgaattttagatttcctttctgtcttttatcctacaatttcttggatgaagtttggagtaattaattgtatcttgatcatgattgcaaacttcttttctacaaattataaggaaagtaactaattacaatgcttaaagacgttttacaccttgtaatcttcatctcggctctcaaaggtagctattttggctctatttgtggttcaagtatcttaaagtatggactccttgtacttattaagagttgcagtataaaactctcatcactaataactttcttttctttttattcttttgagacagagtctcgctctgtcacctgggctggagtgcagtggcactcagtcatagctcacttaacctcgaactcctgggttcaagggatcctcctacctcagcctcccaagtacattcatgcaccaccacaccctgctaattaaaaaaa

SEQ ID NO: 265145 - DNA, 495 bp, Homo sapiens
aagcatgtgaggcatttcaaagcccagtgggcctgtttggaggcaggttctcccacagacatggttgtgcaccactgaaaaatagtcacatgacttttctgagcccataaagtagaaatattgccccaaacaatccctctggtcctcaccactccttaaattcagtgacagactctagatggatgttacagctcatctctgcctgcatctccagcacagcagtgctaaccccaatagcaagtttattccttgtccaggatctgttattacagattacaattaaatcaccaggtttatcttcactgctggcaagcattcaaaacacaaacatactcatgatctcagtatgtaaaagagattgaagaattaaaatagttcaggcaagggggctcatggctgtaatccccacactttgagagacaaggcaggaagagtgctcaaagccaggagttcaagatgagcttgggcaacatagcaagactgcatctacacaca

SEQ ID NO: 265146 - DNA, 399 bp, Homo sapiens
aactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaa

SEQ ID NO: 265147 - DNA, 214 bp, Homo sapiens
catgccaggaatgacgctgggagaggtatcagtggaacagactcctagaagacaacgagaatggtgggattctgaagtggcaggggccatatgatgcaagtaatagttactggcactaattgacaaggtcaaggtgggcattgttaccataatacacaacaatcattgatctgatagtagtcaggtagtatgacctacagagatctttgtagct

SEQ ID NO: 265148 - DNA, 187 bp, Homo sapiens
aaggctatgactgctaagcagcaggcagaacaggcaaccatggagaagattgtatgctgagatggaagacccaaaagattgaagcagcctggataactcgggtaccacacagaggacaactgccctagagagttgccttgacccgcaaaagacattgcctgagatgaaaataaacttttattgtgtt

SEQ ID NO: 265149 - DNA, 398 bp, Homo sapiens
tgagacagggtctcactctgtttcccaggccggagtgcggtggcacaatctcggctcactgcaacctccacctcctgggttcaaacagttgtcctgcctcagcctcccaaatagctgggattacagggtgtgccaccaagcctaactaacttttctatttttagtagagacagggttttaccatgttggccaggctggtctcgaactcctgacctcaagtgatctgcatctcccttgacctgccaaagtgctcggattacaggcctgagccaccatgtcctgcctcatgtagttctttatagcagtgtgagaacaaatataggcgccaacaggttaagattataagagcactggcctcgtgcacaaacatttagagaattcaagacatcacaattttt

SEQ ID NO: 265150 - DNA, 1307 bp, Homo sapiens
tgtcgcgggggcgggaggaattaagggagggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaccttaatatctttaaattaa

SEQ ID NO: 265151 - DNA, 828 bp, Homo sapiens
taccgtcttcagatggagtcgtaggataagccgggtactgctgagaagcttagatgacaactgcacatcctctgggcaacaaagttatagtttgaagctctgcacttgtcattactggcttggattaaggcgagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctgattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaccttaatatctttaaattaa

SEQ ID NO: 265152 - DNA, 299 bp, Homo sapiens
ggccttgagagtcaacctccagtacctgttatggtgggcatgtacaagagaaactgtgtgaccgaggtgtctatcctaacacacttaatgacagagttaggtctggctctcctagcccagtattccattcagggcagattcagcacaactgcagtctaggacaaaagatgattctttcaacttttacttcttcagttaatacaaatgaagaatgatagagaaggagcaactccaagaaatagtgagaagtgtgtagctgagtagatttcccaaaagcattaatagggccagtgttacca

SEQ ID NO: 265153 - DNA, 963 bp, Homo sapiens
ccatagagaggtttacagtagattcacttgagaaggctctgtggtggtgtgaaaaaggtacttgtcctggttgatactgctactacctactttttaaccttgtaccagtcatttaacctctcatggtccagttttcccatcaataaaatgaaagttggactagaagatttttaggatcccttctagttctatgattatatgacatatgctgaagaaaaaatagtttctagttcaggaaaaggataatcaaatttataaatacagaaagcctttataaattcaagtaatttggacgaaggctgatgtgaattggttaaatgtctgaatttgtgaatacttgtaaatcattaacactgcaactattcacgttaagctgtaacttgaattaggctagcaatattaacatgtagcgagatatttgagaaacctgctactttgaataattctgacttagaatatgaattattttggatgactaaaggtaatattttctaaagtagcttaggtattacagtaatacttattaaccttttaaaatgtggtttaaaggcaaagttcagcccctgaatactaaaaataattgaacatacagtacttgcggatcactctgtatgagacaaagggagtagtatgaagttttatgttttttcccccttaaatgaaatctacattagtcttttaaaaatatgtatttttgataaccctagctgacagaactccatcgcaaggttattgacttattttggcagaatgtgtttattattttgtacctctgtacacaagcacgtatgtctcacttgacattcagtgcgtcttaatgaaaaagaacacaaattgctcaatgcatatctggtttccagttatttctacccgaagattatttggtctgtgggtctgcagtgacacctagtgggtgataaggatgtgagcatcaatgattaaaatgaatttcacagctaattt

SEQ ID NO: 265154 - DNA, 459 bp, Homo sapiens
tattttctgtttgctggtacatttttgtgataagctttttaaggtacaggaaaatctctatatatcactctctgaaggagagcaaatgccattgatgtggcttcactccacatgacaaaagacttatcctagtttgcagccaagtgactggaattgatttgggggcatcttaggggcaacaggtcagtctgagagtgtataaaatgtgaactcagagaataagagcgcttgaggagaggaaactgagctcttcctgcagctgcctctcagcatcctacgtgagggatcacacaccccctattccccctcatttgtgagtacatcacccagtgcagatgtaaaaatttatataaaatatattcatatgccaactaaactaatgtatcacatacatttataaaacatacaaactgttacagaaggaagtaaaaaatatcaataaaagtctaatatttattc

SEQ ID NO: 265155 - DNA, 192 bp, Homo sapiens
gcacagtatactttcgttccaactgagctgtaacccctagttactggcacctttaagccatcaaaatggctaaatcactggcacctttaagccatcagcacatggtgaacccagaagttttaactggaagctggtaagacctaaagtgatggtttgcactcaaaagctgcctgtctgatggctttaagacaa

SEQ ID NO: 265156 - DNA, 202 bp, Homo sapiens
ctgggggaggccctcggagtggggtcttacaagggagacaggaattgccagatggacaagcacagagtgggcacccggaagagggaggaggacgttctgaacgaggagccagcgcatgggcactaaagctggcagggggtgggctgggagcaggagatgagacaggatcagggagaggcgcgccctcgggggtctggctgcc

SEQ ID NO: 265157 - DNA, 390 bp, Homo sapiens
ctatatttagacaagtatatttttgcaaaacagcgaaagctcagtgttcctttcaaaatgaaaactttccttttccatacctcactatcaattatttcagtctcagatatgccccgttctgtttctcccacaatatttgacttaattaacaatacagtcgattatttacaaggaagttatttctaaaactgtagttcaaaatcacatctgattttttcacctgacttttgtggtatagttgtttttgtttttaatgatgttgccggggttcacttttcccaaaagtagtttttaagagtaaaaaactggggggaaatcataaatggccaaagaggttaaataaattatgttaccttcattaagtaaaatatttgcagccactataatgat

SEQ ID NO: 265158 - DNA, 609 bp, Homo sapiens
caggactgggtgtccaaggatggggagattcccatattcccatgatagggccagttcctctcagtcatctctccagctaaccctcagaccatcctacaagcagaagctaacatgagagcctttactgagaacttctggggcaccacaggccccaggtttgcgaggagagcaggtcaaagttcagggcagctgggggcagctattgtaacttcagggtcaagagagctttactccagtggttataatcaacttaaaggtcttccctcctctcagtgaaaatgaaccccggatcctcttatcatttggccttcccccttgcacaaagtttatctcctccacagtctcacatccaatcctgagaccttgacaccacagttcaaagatgaacataccagcctgggcaatacagtgagacctcgtctctccaaaaaaacaaaacaaaacaaaacaaaaaaactaattagctacaggtggtggcatgcacctctagtcccagctacttgggaggctgaggtgggaggattgctggagcctaggaggtgaaggttgcagtgagctgagatctcgctactatactccagcctgggtgacacagcgagatcccatccc

SEQ ID NO: 265159 - DNA, 430 bp, Homo sapiens
tctgctcctccgtctcccagaatcctgccctggaaaaaaccagcgccaaccgccggtttaactgaggacggatttaaggcattacgaaagacagctttcccctttgctcggctctccttctctctcctgctgccctgtgaagaggtgtcttctgccataattgaagaggaagaagagctcttaccagggggaggcagagatggcacagcaagagacatgcccccagaatgccaccaatgccccaggacaggcccacccatgggaccaggttatcgggataacctgggaggatggggtggaatctgaggggtgagccttcttccccaggctggaagtgggcgacacgagactggcacctctacatctgattgtcccccaaacccagcatttatgtcgtgagcaaagaaagaaatcatgttacttcttccag

SEQ ID NO: 265160 - DNA, 326 bp, Homo sapiens
  misc_feature (32)..(33): n is a, c, g, or t
  misc_feature (52)..(52): n is a, c, g, or t
  misc_feature (56)..(56): n is a, c, g, or t
aagaccacgacaacacaccaagaatcacaacnntccctcagggagactgaanaagnacgaagaggaagaagagctcttaccagggggaggcagagatggcacagcaagagacatgcccccagaatgccaccaatgccccaggacaggcccacccatgggaccaggttatcgggataacctgggaggatggggtggaatctgaggggtgagccttcttccccaggctggaagtgggcgacacgagactggcacctctacatctgattgtcccccaaacccagcatttatgtcgtgagcaaagaaagaaatcatgttacttcttccag

SEQ ID NO: 265161 - DNA, 321 bp, Homo sapiens
ggaatgtaagtttacttaacacaaaaaaaaaagcgcttaggaggagcagacgagaagaggaagaagagctcttaccagggggaggcagagatggcacagcaagagacatgcccccagaatgccaccaatgccccaggacaggcccacccatgggaccaggttatcgggataacctgggaggatggggtggaatctgaggggtgagccttcttccccaggctggaagtgggcgacacgagactggcacctctacatctgattgtcccccaaacccagcatttatgtcgtgagcaaagaaagaaatcatgttacttcttccag

SEQ ID NO: 265162 - DNA, 360 bp, Homo sapiens
tttttttttaacatcatcttatactatctttaatttcataaaaaggatttaagggtctctctcccacctattaaaaatctaccttccacacttgtttccacccttgcttcctcattttgatgatttattttctcaaaccaaaatcattaaggttatgtcacagtttcttctaaatctttgtacctcgtaacccatcagtcaccaaggtctttcaagccttccttcccaatgacttttagattttgctcctgtccttcattgcctgaatccttagccctttatgcctgggatactgaaattgcctgccaaccagtgttataaggtagaaaatgctacattaataagttccacaaaaatctt

SEQ ID NO: 265163 - DNA, 491 bp, Homo sapiens
cacgaggttaatcccaaaattaggattataatgtatatatagctttgttcttctttgtttacttaatgctataacatgttcttttcctcatgtcattgaaagtcacatttttgtataaagtactcattgcttagatggatcatgatccagtatattctgttgcagtgggaagaggagaggaactttggtgcatcccttttgcttccaggcctaaaacaaaagaactcagtgggtttcagttcccagttgtatggctatgcacttcttggtaagctaaatgatccttacaaatactgttcttcatggttagaattgttgcattcttccagttcataataaaattgtaatttgatttaaatttaccagtgaaatccaattagccttcgtttttagacataaaaatagaccttgatggccttacagttactccataagagagtaaagagggttcttaaaacctgccatcactggcaaagcaagaactagttctg

SEQ ID NO: 265164 - DNA, 186 bp, Homo sapiens
gaaacaacctaattgtctaaaagccgagaacagttaaattgcagaaatacatactgtgtagctattttaaaaaatgaactggttacgtaggaaggatgtgtatttttttgagtcttttaaaaaggcaagttgcatgacaatatgtatgatataaacccattaaaaactctataggaatatttatta

SEQ ID NO: 265165 - DNA, 667 bp, Homo sapiens
tcacaaaacgtcttccaattgtgtttcactttcacatgtcagatttcatgtaatgattgctaattactagcaacccagacaagatatagacttatgaaattgcctcatgagtttagtgatttttcagcaactggaaggaaatagaaaatccttgggtcagttctacctgagttctaatcccagctgtgtcttttacgagctggtgggcttgagtaagttattcaacttttgtgtgcctcagtttcctcctctgaaaaatgtggatgataatagtacctaccagttagggtggctgtgagaattaaaaaagatgattcgcataaagcactagtttagggcccaatagtaacatgtaatatcccagcattttgggaggccaaggcttgagtccaagagttcaagaccagcctgagcaacatggcaaaatcctgtctcgtctaaaaatacaaacaattagctgagtgttgtggtgcatatcagtagtcccagctaccagggaggctgaggtgggaggattgcttgaactggagaggtggaggctgcagtgagctatgatcacgccactgcactcccacatggtggaccagagtaaaaccctgtactttgggaggctgaggtgggcagatcacaaggtcaggagatcgagaccatcctggctaacatgatg

SEQ ID NO: 265166 - DNA, 342 bp, Homo sapiens
gctataagtattaataagtaagtgcactagcaatactactagaaattgagtatttttgaacatagccagccctcaagtgaataattagctcagtatgaaaggaactaaaatggtcatttttctcacagggcttcaagatacaagagcccaaggcgctctagtctcctttgggtgtttgaatttcctctttaaacacaccaacagtaaaagaactactatttcaaataagcagtaccataactgactatatcttccaaggttttggatgcaatctaagggaaagggggaaaagagacccgacttggcaagacccgtaccgaagcagtctggaaaaaaagcaaa

SEQ ID NO: 265167 - DNA, 651 bp, Homo sapiens
tgaacttaaatcattgggggctgttatgaggattaaatgagcttatgcatgaacgctctttgcacagtaacactaagtgatagttattaatcctccaccagtatcaccctgtctaggcaagcccctggaaaaatcctactaattctgtaaggattatctccaaacttttcttcatgccctggtgatactttgaacctctcttatggcacttttcctgtttttctgtttcttacaattataaatatacttgcctaatctcttcctgctagactgaaagtaacttgagggtagagatattgtgtatgtgtctcccacaaagactaacagaaaatcttgcataaggtaggcacttaatacttactgagctgaattaaattgcactagtttatatttaaaatatacttaccaataagtaccatcagttggtgtcatgttatgacactgccattggcctttactttccttctttccagaggtctatcatttgtcctgcagtgatagttcaagattatctgccatagaagtgagttgggagttcatagagtttccagaaagtcttttcctgtaacactcacagaaagtcatagagaccaaaatgagattgtgggctctgggcacggtagctcatgcctgtaatcccagcagtttgga

SEQ ID NO: 265168 - DNA, 249 bp, Homo sapiens
aaaaaaaaaaaaaaaaaaaggttcccagaagctgatgccagtcaatcattggggctcccagtgcacaatagctactgtgttcctgtgttgcctgcatctgtcaggtaccgctttcaatgcaagatgcaatcatggttgcttccctgctgatgggattttggtgttttagcaacattcacatactttttgtttagaaaattatttgctgatgttttaagttaaagtcaataaaggaggctattttctgta

SEQ ID NO: 265169 - DNA, 726 bp, Homo sapiens
gtgatttatttattttgttgagggtttccaaagaaccaactctggtatttatttgtgatttggggtttttaattcattaacttctatctatcaatccctttgtcttgctttccttgtatttactttattcttctcttattaacttgaattgaaaacttgccttatctatttttcttctgttcttcataacattgaaaagcatttaaggtcatgaatttgcttcattataactttgacagttctcctagctcttgatatatagggttttcacgttcctgttttctcactattttgcaattgcagttttaaattcctctttgattcaaaagttacttagaaaacagttgcaatgtttttatgtttatgtttaattttcacatggatggagatttttggtttctcttttgttgttaatctccatttttgctgtactaggtcaaagcactgacctgtacaatttctattaggggaaatttactagaattttttttcttactttgttgcctaatgaatgcaatatttctgtaagtgtcccatgggcactggagaagaactgggcttctcagccttaagggcacagtttgatatgtaaactattaagtcatcttactgattacattactcagaatccccacgttcttattgacttctcaggcccttagggagttatgttatggttttccactcttactgcgtatctttcaggttttccttatgttcatgggt

SEQ ID NO: 265170 - DNA, 433 bp, Homo sapiens
gaaacagccaaaatggttctgagtcaaggtgattgtgatgattgtgacattagagagaatgaagatgacattttaacactgcagaaaaagtgcctataggtggcatggtgaaaatgtgtgatgggtttactgaaggactagagcagtgtgtattcataacagaacaataaatcatgtcagtttgtaaaatcaaagggagacttctaagttaaaaactgttgttaatgaggcagaggaactctggaggaaacatcttaaaaagccatttagcaaaatgcctcctgatacctagaggacccactttctggtccctcaacagcttctgctatttctcctcactccccaaaataaaataaagtgtacagtaaccttttaatcaaaacacagcattataggtggaaacgaaaaggctgctgttgtttgctgctgttgc

SEQ ID NO: 265171 - DNA, 246 bp, Homo sapiens
gggcaacagtgaacgtcaaagaataataaattactgtaaaattaagtatggcagcttctctgtcctctgcaccatttactagacttcccatctgaagagttgtcttccccttttatgacaggctgttttaagacagagctgatatgatgaccataattaggtcttgggagagaaattagatcaagaaattcctgactgcttcaagctaatgtagagaagggccacacttccttctgacaatccctg

SEQ ID NO: 265172 - DNA, 417 bp, Homo sapiens
aaatcataagggtaaaactcaaatttttacatatttatgtggttggggtgtgaaaagttttttaatggagagttgacattgtcctagaaaattcttccgtatgtggcttttaaatgtatgattataggccaggagcggtggctcacgcctgtaatcccagcactttgggaagccgaggcaggcagatcactcgaactcctgagctcaagtgacttgtccgcctcagcctcccaccaaagtgttgagattacaggggtgagcccctgcacctgacccatagcagtttttcatttaaaaaaattattgtatactgttccatgatatgaatatgccacaattcatttatccattattgtggatggacattaggttgtttccagtttggggctattatgaataaaattgatatgaaccttc

SEQ ID NO: 265173 - DNA, 656 bp, Homo sapiens
tacttcccagagctctcagccaacaatggtggtatcctccaagagcaaaccgaatgcagaccatgttacattctgagggctgctggaaagccctgctcacacctcaaaggaggaagattattgattctttgtaaaagcatcaaataggtatcacatcagactctaggaagctcatcctgcacccagagaataaaaatactatttgagatgctcccaaactttacttatctaagtggccatatcattggcatcattcagacttacaatgtgtgcactcagagctgagaacattaagtattgattgctctttaaattcacgtagactgaatcattacagtcagttttgcgagtttcattgttttgttgggaacaaaagaaaattctccataagacatgatgacaggatgggtacaaaaaacagtgagcaaaaatgaataagacctaatatttgctaccataacagggtggctatagtcaaaataatttaattatatatttaaaaataactaaaagagtataactggactgtttataatacagaggataaatgttgaggtgactgagaccccatttaccctatgtgattatcacatatggcatggctacatcaaaatatctaatgtaatctacaaatatatacactactatatacccac

SEQ ID NO: 265174 - DNA, 376 bp, Homo sapiens
accaatacctgctaaatattctattttcttacagctcacaccttaggattgattactttgctttgcaataactatgaagaagaaatacaggcttgttatggtttgaatgcatcctctccaaaatttaggttttgcccacattgcagtattaagagatgattagaccataaggggttttcccttgttaatgggatcaagactcttataattgaagctttagacaacattcatttagcttgcccttctgccacttgtcaagtgatgatgccacaagaaggccctcacaagaccagaagctggtgccttgatcttgaatttaacagcctctagaattgttaaataaattgagaaataaatttttggtttttattagtga

SEQ ID NO: 265175 - DNA, 467 bp, Homo sapiens
cctttaacactgacttatttcttaatcatggcagtttaggcatgccctgttttaaaagaaaatcctatctatgagaatccatattgaaaacacagacatatccataggtaatgacatctgcctctgttaaggtttttgtttttcccctctttacaaaagaagtcacctcagtaaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccaatgttgctgaaaagaattcagcactgagtaggggtagggcaggaaatgagggattactgcctggggactggggacgtagaagaga

SEQ ID NO: 265176 - DNA, 705 bp, Homo sapiens
caaatcaaccctttctctgggctatctaaaataatcaggtactagaccaaaaaatgacatgctgtctgccttaccttttagtgatgatttgtaggaagaggaaggtaggggctggtgagtggaaaagtagtagagtttgtgagggaatgttctgtatgtctgaagacaaagtctggagattggtgggccagaaggtgtgaatctactctgaaggacaggcaagagtccagcccagggaaaaaggtgcagatgggtaggatttgggtgggtacttgaattaaaaaaatgaatttgtgaggcaatattgctggagtcaaaaccaaaaaatcaaattgaccagggcaaaaaatagcctggggcctagcatggctctgctgccacgtaggatgactggacctctttccaggttcgtgttaacagtccatactacttatggtatacgtgaaatgctttctattcattcaagcaaccttactaaaaacaccccatgaaaataaaagtctatatcttcccttcaatatacattcatatgtgcttattttaagcatatatctaccaatttgagtttggcattctttttcatttaatattattacctattcagcttccaacattatcacttccttactacacacatctgtttcctaggactgctgttaacaaattgccacaaatgtatggcttaaaacaacagaaatttattat

SEQ ID NO: 265177 - DNA, 480 bp, Homo sapiens
ataattatagaacaaaatgtgcttaccttttagtagctatttaaagatatttgctcctaggttttatggtcaattaattagtaatgaaaatacacatgttgcttagctttttcgtatatgttgggagcataggtgaataaaggcaaataaagttaaaaagcaagttgggatctagattattttgtctttttaatgctaggttcggatgtttgcagaagacaatggtcacttgactttaaggagacaaagtgagaggtttccttttgttagccaaactagctttatttctaaattgtgtcagtgaactataataattttcagtgggacaaaagggacatcatactggacttaataatacctgggtgatgaagtaatatatacaagaaacccctctgacatgtatttacctaggtaagaaaccttcgtgtgtacccccgaacctaaaataaagttaaaaaagggtgactgatatggtttggc

SEQ ID NO: 265178 - DNA, 1790 bp, Homo sapiens
gaggtgcccatttaagctagatgtgcatgtcaccacagatgagtttcagttagggcttatagcagcacatggagtgcctgagcatgccaataggcttttggtcccaactatggaagggagctgagctccagtatttcttggtagagaagcagttagtaacagcaggatgggtgtgttcatgggtaaccaccccctcaactgggaaaacagtaactgcatatgctgccctttaggctcacaaaagtgtgtcaggatgggttacagtcatcgtatgggccacttacctagtagcgggaggggtgtgttcatggggaacaaccccccagacagggaaggcacagacatccactttagcaaagtggggtgcctacttggagcagcaaagtatgccaagtcccttagcagcaaagttgcaaaaagtcttgggacctgtagtcctaatgcaaaataagactgtggggcctaaggcatccctagaccctatgctttcaccattaggaagagcgtccccccattcctaatagggcatggtatacagatgggtctagccaaggtgctactgctgcctcgactgttgttgcagtccagcctagtactgacaccatatggtttaaaaccagtgtacgcaaagtagctaatgagctaaactcacagcaatgtaaatggtaatcaccaagaaggtaacactgatggtaatctgtgccaatagctgggcagtttatcacagcttatgtatgtgtcaaatctgtatatatacattgggcctgcgtgcccaatgcttatgggtcaggcttatgtgtcaagcctatgtgtatgtattgggtttgcatgcccaaagtttatatatcaggcctgtgtgccaaacctgtgtatcaaacctgtgtgtccaaggcctatgtctccctcggcctaggggatggaatgtaaggtacacggatgtgctttggtcgaagaatagaccaaggcggatatccaggcctgcaggaatcagcaagtttggtgcacaggtgcaaacctccacttgttatataacctgtttgtataagttcatactttgctctgagccactattgcctgtgaaaggtataattgccctgctaatgctatacagcggctcgtgggcttggcttggctcaacatagcaggtgcacttgtgcccagagaaagagagagtcagagctatccatcttgcagatgaacaggagggagctaggacatagctcgactggcttgtggccagagacagaaagagttaagctgctgacccgaaaggcagggcagagccggctgtacagctgtatgtgggagccactagctcaagcagctgagacagggaagacagcataaagagctagtgtgagaaagttgttaatgagagctgctgctgaataaaaccatattcacctgcctaaggccccctgagtgttctttctgcccatccacccacttccctcatacttcagcatgggctagacccagacccccggatctgacaaaggtgcctgcttctcctttgccttttgccatgattgtaagtttcctgaggtctcctcagctatgtggaactgtgaatcaattaagcctcttttctttataaattacccagtctcagatatttcttcatagcagtgtgagaacagatgaatacatattgtctctgacaataaatgtgttctcactcatatcattcttcgtctgtacataaatatttatttctgattacttttataattttttaaattggttctgagtaacttgattaaaatatgacttggtgaatttttttttca

SEQ ID NO: 265179 - DNA, 437 bp, Homo sapiens
atagaggatcttccacaccgcaatctctccaggtgattctgatagatggtaaagtttgagaaccattggaattgttgtagcagtttttctgtttgttggaaacaaaaaattaactagaggtagttaccttaatttcacacttcacagcttaaagttattttaaaatcgtttcttcatatttcctgccagttgaatttgctgacatttttctaaaccactaatggtatcttaggcacagtatccttgaatcacaggcagtagtattaagtttctgaagactgcttctccccccaccatgctccttaagtcttatttaaataaccttcagtgagtacagaaggggcccattactacgcccttcctggtgacaccagttaaccaagccagggcaagtaagtgtaccctgcagccctgccagccaaagattgctacttttt

SEQ ID NO: 265180 - DNA, 684 bp, Homo sapiens
gggcagatcagcagaggtcaggagttcgagaccagcctgaccaacatggcaaaatcccatgtctaccaaaaacacaaaaattaaccaggtgtggtggtgtgcacctgtaatccaacctactagggaagctgaggcagaagaattgcttgaacctgggaggtggaggttacagcgagccaagattgtgccactacattcttggatcctaccccaaacgtactgaatcagaaagtctggcagtggggactcaacagcctgtgtttcaactagtctctccaggtgattctgatagatggtaaagtttgagaaccattggaattgttgtagcagtttttctgtttgttggaaacaaaaaattaactagaggtagttaccttaatttcacacttcacagcttaaagttattttaaaatcgtttcttcatatttcctgccagttgaatttgctgacatttttctaaaccactaatggtatcttaggcacagtatccttgaatcacaggcagtagtattaagtttctgaagactgcttctccccccaccatgctccttaagtcttatttaaataaccttcagtgagtacagaaggggcccattactacgcccttcctggtgacaccagttaaccaagccagggcaagtaagtgtaccctgcagccctgccagccaaagattgctacttttt

SEQ ID NO: 265181 - DNA, 432 bp, Homo sapiens
tttatggcacttatccctgaatgttatctgcttattgtctgcgcctcctaccataaggatcagaattttgcatcatcttatccttagtgcttggaacagtggtataatacatagtagacacctaattaatatggttaagtaaacaatatctatattacagagaagaaggcaaaaataggtagattggcaacatagaggagagggtgatcaactctgacttttggtaatatgtaaaatgggtatgactagaagtgtttgagggagatttagaggcagtggggcaggatgtgcataaacaaagaaccttaaaacagcatggcacatctggggactgcaagttctcagcctggacacctcccttaagcttctggcctgtatacccacctgcttcctggattatctcttcctggacaaggcattcataggtacctc

SEQ ID NO: 265182 - DNA, 765 bp, Homo sapiens
atcttgcaactttttgaatcctagagatgaaatacacaagtcagaggtacagaatatgcaatttaggagaagcatttgtgaaaaaacaggtatacttagaaattttagttaacacagtacttaatcccagctctggaactcacctatataaaaatgtgtgtgtggcggggctgggggctaggttattctctttaacttagagaatgcacacagcgtccctcgcatatgcatggcacttggaagctactcaataaatattaacttcctttccttccctcacaatatgagtcaacaattgatgcatcttccaaggggtcatggggaggactgtcatcgttggtggcacgagtgcacatatggtttagaatgtcggaggtgattcgccctgctctatattccctgcctgctgtctgcctctagctctggcaacctcattctaagtggaaagcaagatgagaggggacttaaagacacattcataataggaactgagagttatcagtcattggtgaatggtgttatatgcagagcccttaagggaattggagaagtttctctagagaaaagggcagataatataagggctattttcaaatatctaaaaggctgcctttctagaaaagtgattagccttcattaaaagctagaaaaccagattttacccagtattaaggaagaactttctaatattcagaactgttccaaagataaaagtggactccccaggaccccagaggtggtttacaagtcatgtgggcaattatt

SEQ ID NO: 265183 - DNA, 455 bp, Homo sapiens
agttttacttatttccaacaaggcaagttttcctgcttccatgatgatggagagcaggcacctcctttcttgagtttcagcttgcttctgacagggaaggtgagtgtaagttttttccagcttctaagatggcagagaacaatcaccagcctgagacttatttccaggtaagtagctgaattagagttttgtcttaaaatttttccttaatgactaaaatttaagattactcaccagctgcttttaatttctccttaccattagaacactcagtaatcatatgaattgtgcatttgtttgttttgcttaactctttttgtttgtttatgtttggggttttgttgatgttgtttcacttttctcccatctcttcctgacttggtcagatccaaagaatgctccaaattgtggggaacaaggcttctgaattggctaaaactcatgtggctgcaaaa

SEQ ID NO: 265184 - DNA, 811 bp, Homo sapiens
atcaataacttgaaggagacagaggtagccctgtgattggaggagtgagagcatcccaggctgggggtacggctgaggcaggggccaggaggtgggagggcggccaatgtgcaatactgggacctcaggggcacgaccttggtgccttgattggtggtaaaaatttaaagtagaagcagctgattgctgagcagagggccttccccagatcccaggaggctgcagtgggtctgatgcttgttttcaggtttctagggggttgctaggtgattgggatcacagccttcacatgcctggtagaccctgttttggtttcccactgctgtcctaacagatcacaaactgggtggcttaaaacaacagaaatttactctctcaacagttctggaggccggaagtccaaaatcaaggtgttagcatggctgtgcttcctcagaaggctctaggggagagcccttccttgcctcttccagccctggggaccctaggagttccttgttccttggcttgtatgtgcatccctccagtctctgcttccctttgaatgtggccttcccctctgtgcctgtgcgtcttctccactttgtgtcctatgtggacacttgtcactggatttagggcccacctggggaatccagaacaaatctcatttcagtagcctcaatttaattacatctgcaaagacaccctgtattggtctgtcttcatgctgctgataaagatatacccgagactgggtaatttagaaagaaaaagaggtttaatggacttagttccatgtggctggggaggcctcaggatcatggcagaa

SEQ ID NO: 265185 - DNA, 115 bp, Homo sapiens
atgcccgccccccatccgtccatgcctgtatcatctaacaccttcctgacactcctacgatgattttttttaaaggcacctggtttataatctttctctcctagattaaagatct

SEQ ID NO: 265186 - DNA, 774 bp, Homo sapiens
agaaacccgcggatgggtgggccggcagctcctgggacgcccgactcacagcggagccgcgtgggatgagaaggattgagggagagaggggggccctgtcccagggtctctaagaagtcccccacctctgtactccccagcccagcggtgacttcgaggtgggcccagggggcctggagggaggggcgtggatacagcgggaaaggagagacccctagcggggtggacaagaagggaggaactccacagaactgcttaatccggctccatccccatcagcgggctttctcagcgcctgcacccctctctatcccatctcgaagcctccagttaatccagagtgagacgcaggaccgccgggaggcgagcggggatgctgaagctagggcaggctaaagccccgcggccaaagggcaggcttgtgcgccctccgccccctctccgccccctctccgcccctccgcgcccaggacctaattgtttgcaaaagcaaacacggaaaaggcaggtacaaaggtcgggaggagggaccgggacctgcttctgcctggggtttcgaccttcccgccagaagctccactggggcctggacctggagaagggacatcaacagttaacgtccagggcagctttcagcggcgtgggcggggatccccagggaagcactgttagcagtttcttgtacatccagcctggtatattttctgcatgtataggcaaatacctgtttgtgtgttcttttctttcttttacataaataatcgcatactaggc

SEQ ID NO: 265187 - DNA, 328 bp, Homo sapiens
  misc_feature (41)..(41): n is a, c, g, or t
cccgaggtggaactgaaccacaagctgataaaaggcatccnaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactca

SEQ ID NO: 265188 - DNA, 450 bp, Homo sapiens
aaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaaaaaaaagaaggaaaatttgagggtttttgattttttcaacttcacataccggtttgcctttgcaaaaaaaaaaaaattgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgc

SEQ ID NO: 265189 - DNA, 313 bp, Homo sapiens
acaaattttgaagataatacttttttgggggtggggaacttctgctgttattgttgctgtgctggaggaatggtgcttattcttttggtagcataactagtggtctgacatgaaaaactcttaaaacttaccctatattgggtctttaactgctattttatgttaaaaccttacatattagtatgtatatatatatgtgaatgcatacatatacaaactacattttcttatttttaaaatatcttaaggtacatgaaggagttaacatgttcatgaaacattgtgacatggaaaggtacttaggacttagtct

SEQ ID NO: 265190 - DNA, 402 bp, Homo sapiens
caaagctgaagtccccgccttggagcaagtcaaggagtaatggacagacaagtgtgtacagacataattataattaaacataaatgtgataatggagtttgttgttttttcatggcagcttcaaaccatgaaattaaaaagctactctgcagggacaggaaatgatcagcactccagaaatagagttggagagatgctttccttatggtccatttctggccatttcattatctctgtcttgatgggactctatggagcaggaaccacctcttagcctggcattgtggcaagagcctcagttctctgtcagacaagcttgggttcaaatcccagtcacttattaataatgagttctttcaaggttatttcctcatctatgaataaaagataaaaacgcatcca

SEQ ID NO: 265191 - DNA, 488 bp, Homo sapiens
actctcggcttctcctcctccacccgcccttttgtctgagggacccgggattttgcttttcccttatagaaatggtggagtcagtgaagaaattagcagggatggatgtggagctgacagctgaagaaagaaacctcctatctgttacatataagaatgtgattggagctagaagagcctcctggagaataatcagcagccttgaacagaaagaaggaacaagggaggagaagacaagctaaaaatgattcggaaataccggcaaatggtgagactgttgtacaacagtccccccttatccgcagtttgagttaccagtggtacagtacaataagatatttttagagaaaagagactacgttcatgtaacttctattagagtatgttataattgttctggtattaatctttttctgtgcctagtttataaattaaactttaccatgagtatgtatgtacagaacaaaacatagtatatataaagtttg

SEQ ID NO: 265192 - DNA, 1093 bp, Homo sapiens
ctccttggaacagcggcccccaaaatgcaactgaagccatttccctgctctgagacctcggacaagtcactccccgccagggctgcagtttcctgtctctaaaaggagttgatgagcagctctaggtggggtggcgatgggggacgcaggaggtgccccgtgcctgtggtcccctgttgaagttcacgcctcctcaaatgcagcggccacccagcgctcgctgggtgccatgtgtgccccacaaaacacctttcctcagcctcgaggacaagtaccagaggccagttccgcgggaaaagttaatggtggtttcctccagggtccctaaagcccctcctgaaaagtgactgtggttcccctccccctgtcctcaggttttgagtgggcacaacctaagctggatctgataggccctgtcacctgctggttcctccctggttgacaccaagcagaggggcaatgctctctcgctgtccttagacccaagcaggagaaaaatctaccctccctccttccctccccattccccatcacaccatgattggcttttaagcttcagggatgtttcccggaccgagtgtggcttcagagtcagagagatgtgagttcaagaccacttgcttaggtaagtcacactgctccaagtttcagtttcttcatctgtgaaatgggagcaataaccacctctttttcaggattgccattgagatcattcgtggaatccataaagtgcccagcccacaggttatttattctgtccagcttttattcaagctttttgcttagcactgaggaaacagcaattcacgaggcaggcatggtctctgccttcatgcaacttgcattctaggaggcagacagactgtggacagcaattacagaatttcatgacagttatacaagtgccatggaacatatagagtacgataagaccagatatccagggaaactgacctggtctggggctcaggaaggcctttcccaaagtgtgatgacatcgaagctgagacctgaagtcaattggggcaccaggattgcagttggtaggaagtgggcagggggtgctaaaagaggtggtggagggagagcgttc

SEQ ID NO: 265193 - DNA, 382 bp, Homo sapiens
ggcaacatagtgagaccctgtctcttaaaaacaaaacaaaacccttacgccgtacacaaaattaactcaaaatagacttaaagagccaaaacaatacaacttttagaagaaaatttgagaaagcctctgagaccttctgttaggcagaaatttcttagatgtgatactagaagaacaatcaataaaagaaagttgattaattggtcctcatcaaaatttaaaatgtttacacttcagaagacagcaataaaaataaaaagataggtcaggtgagctggctcacacctgtgatcctaacactttggaaggctgaggtaggaggatcaggagtttgagaccagcctgggcaacataatgagaccccaccccccaacctcttaaa

SEQ ID NO: 265194 - DNA, 229 bp, Homo sapiens
cccaatgtgttgagattacaggcgtgagccactgtgcctggccttggatatttcttttaaaggctttttaaaagttctcctagttctattccattgatgttaagattgactgggctagtccaaaggtagtcagttatttcaattggttgttcacggttagttacagatcaaactcttgttatactctttcccccttctcactactgcacttgactaattaaaaaaaaaa

SEQ ID NO: 265195 - DNA, 390 bp, Homo sapiens
ttcttcattcatccatctcccccacaagactgtgcaaaccgtgagggaatggaaaaagtctcttaattcgaattcttgcttcagtttccctccattttttggttgtgcacgttgagccagtttatttttcaaggttcctccatctgaaattaggaattatgtgccaatatcttgccagtttgtttgtaaatatgactggtgtcatagttacagcttttgttgcattgcatttttaggcagttatgttgccaagttcttaggcatatgtgcaaaagttgtatacatatattaacatactggtcttatacatagaatcaaacatcactcaaagtggttttgcttaacaaaatattatatagacccttaaattattatttacaaaagtaaaaa

SEQ ID NO: 265196 - DNA, 236 bp, Homo sapiens
acagtggggaggccttggcccaattcccagccctgcctcctccccagcccggggtgcctgggcctccagagtcccctgcccctccctgctcacagatttggggggtgctttggtcagcaatattgtggggagttactccagaccaccctggccatgcaccccggggtccccgaaggccctggggtctccgagcccggcccccgggagctgtgtgcctttgtgagcggggcggccgc

SEQ ID NO: 265197 - DNA, 632 bp, Homo sapiens
ttacataatttttatgtaaccataattaaaccaaattagtctttttttcttcatacttttcttcggtaaatagtgaagaaataatgggcatatctaattaaccagttctagtgggtgttgtgatatctttatatctagttcagtctcagatgtatgaatatgattatatagtcatgattgaagttcaaaatgaggaagtatacaaaatcctcagccactgaaaaattcagttaacttgtttatactcctgtaagctctagttagtcacaagacaaagtatatagtaacactttgtaatgaagtaacattttctgcccacattaattttactaaagacctaaattgttaaaattaattgccaatctctggatatattatgcttagtaagtgttttgaaattaaagaccttaaacatttcagcaagtaaattttggattctagctctgttttaaattgaatcctaattttcaaaccactgctaccccagattcatacctgtttttgaaatcttgtttatggaatggaaaattgacagtatggtaatagtttattgactgattggacaaaggatattctggttttaactgacttttccatttaaataaaattcatttgataattttggttgcaaa

SEQ ID NO: 265198 - DNA, 492 bp, Homo sapiens
taatagatatatttatatttctcttttatatataaatatatataagtataatataatagatatatttataatagactgaatacagtcagtctattacttcatagaataaagattagaaggaactgaatatattggaaagaacagtccattagttttgtcatttttttaagagtttcattagcaatcttctaattcaagctgttccaaagaaataggtcgttttcacagttgtcccttttaattttgggaaatgagacaggagagaaggaaaaggaggcgagcaaatttttactcacacttaacactgggctggaagttgtggtcactctgagcacatagagcggattaagggacatttttgctttcaaggagctcagagtctggttctaagagatttttctcaactacccctaatgtaagcgtcttctagattttataatgcttacactcaaaatctatccctctcctaaacaatgaaatagaaaaaaacaa

SEQ ID NO: 265199 - DNA, 641 bp, Homo sapiens
aattagatggcccagatatttaacttgtgtcttactagttataacttttctttagaaatcttatgacatttcgcagctagatgttttaataaatcaacaccatcttccttacaagccagctacagggaagaggaactaagtagatcatctacatatcatagtaaggacaagtcccggggaaaacttccatctcctaaatcaggcttcagaacttgagagaaatagaaaggactttcagtacagtcctgaggcataagtctaaatgaactattgtccttccccagtgaagcaaatagttactcactggtttgaacaacaaggataatgaagaaggcactgcagaagtcaattacagccaggggcagtggctcatgcctgtaatcccagtactttgggaggctgaggcaggcagatcacctgaggtcaggagtttgagaccagcctggccaacatgatgaaaccctgtctctacaaaaatagaaaaattagccgggcatgatggcaggtgcctgtaataccagctactcaggaagctgaggcaggagaatcgcttaaaatcaggaggaagaggctgcagtgagccaagatcgcaccattgcactccagcctgggtgactaagcaagactccatctcaaaaaaa

SEQ ID NO: 265200 - DNA, 411 bp, Homo sapiens
cccatttttcagtggtattaattcttggttttggctattctagttttctgatggtaaagtctacctttaataatatgtctgcttctacttcttgatttatcaattctatatggtattcaatgattccttgcattgaaagattaggaaattactgcaattattctgacctttgtgtgttcttcctcctctcccatccacgttagttataaaattttaaatcatggaccctaatgttagtctgaattcaattcccacctctgccacttactggctgtataacttcgggcaagttacttaacctctctgtgttccaattttctcatgagtaaaaatgcggataatgatactaactgcttcataaagttgtcatgaagatgaagaattaaaacatttaatgttaattcatgttga

SEQ ID NO: 265201 - DNA, 529 bp, Homo sapiens
tgctagagacagcttacctgaatcatgcagtgtatacaggatgtcagtgaagaggtctggcaggaatgcctcactctcttcctactgactggtacatgttatgatgcagtaattatcaccaattccccaccctggttattagcatcttactctgaaggtaacttgttccagttgacccaggaagaaattcagattttactggcaagagaggggagagagaaattgtttctccaaggagtcacccttgcagggaccaaatgcttgttgatttgagacaatctgtacactgaaggcaacaacaccatgtacctgcgcaccaaaggccagagtcagggcagccgggcagtgacggtagttcagatcgagtctgtaaggcttgtggtgattggacagaaaggaacagaaggagggcctctcaacctcgaagcttttgagatggcaggttatgtcagagaggccattgagcaacatgtggcccatttataactaaataaaaaatagttggtgtttgacctgtaaaatgaattca

SEQ ID NO: 265202 - DNA, 609 bp, Homo sapiens
tttacttttatgatttgttagatggatccaaagcattgctcagtccagatctaatcattccctctactgaggcaagaccttcccaaatatatcctacccaataccctgtgactaaatttttctagtctctttgctgggaacaggcactgttccaagccctatgcgaatgctgggcattgttctctataatcctttaagatgttttttcttctctgcctctgctagtttcctcacacacatgtgctttgctgaatccttgaaggggcgggccccctctgcaaatctccaaatttctctctttctgcagctctcccctctctctggtacctttttcagtgaattatagctgccttggtctctccagactctcagctcccattgattcaacttgtggagtctacctggaaagcctcaaggcaataagatggggcaatcccagggttcagctcttgtttccttttttcagggatcactgtacttgttgtctgatgtccagagtcttctgttgtttttgtatttggtctgtttgagtattgttttttcaataagataagtccagtgcctgttactccatcttggctaaagcagaaaacttgataggtgctgggg

SEQ ID NO: 265203 - DNA, 464 bp, Homo sapiens
tttacttttatgatttgttagatggatccaaagcattgctcagtccagatctaatcattccctctactgaggcaagaccttcccaaatatatcctacccaataccctgtgactaaatttttctagtctctttgctgggaacaggcactgttccaagccctatgcgaatgctgggcattgttctctataatcctttaagatgttttttcttctctgcctctgctagtttcctcacacacatgtgctttgctgaatccttgaaggggcgggccccctctgcaaatctcccagctacttgggaggctgaagcagcagggtcactcgagcctgggagtttgaggctgcagtgagctatgatagtgccactgtactccagtgtgggtggcacaacaagatgcattctctgacaaaaagatttgttaaataaaaagataacctgaatgcaattattataccaaaaaaaaa

SEQ ID NO: 265204 - DNA, 410 bp, Homo sapiens
aataagttgatgactgattaaggcaggtgttatggttactatacggccaccattgcttccagtgagaacctctctatccaggaaagatcttcagttgcatagtaaagggatattgactctaaaggaaagatataggtgtttgctccaccctacccaaagggaaaaagaagcagataataaaggaggttgttttgaaaacacttgtatatttgtttattaaagttcatatgttggccaggcactgtggctcacgcctgtaatcccagcactatgggaggctgagacaggcagatcacttgagtcctggagtttgaaaccagcctggccaacatggcgaaaccctgtctctactaaaaatacaaaaattagccaggcatggtagcaagccccctgtaatcccagctactcag

SEQ ID NO: 265205 - DNA, 369 bp, Homo sapiens
ttatgttggaatattaggatgctgtgccatagtttttttcaggcagacatttcatttgctataaactgctgagaaaccagaaaagagcaacactcatgctttcagatgcatgaaatatagggaaaaaattccaaagcaaacatatcaaaagaataacctgtgatgggtttttatattcagatggctcagtgtaagacgtattttctcctttgagtcaccaaacccagaaaaaaaaaataccactaatctagaatgtaatgccaactctaagctccaaaaagtttttgctcatatgtacaccccctgagcctaggctagttctttgtatgcagtggatgcttaataaatatttatttatatagagaaagc

SEQ ID NO: 265206 - DNA, 1222 bp, Homo sapiens
ttctgttacacaaggggtaccaaagtccactctgagcttttcctctgggaacagatcccagattattccagacttaagacatggagatatatcttgctagagcccccagtatatattcagtgtgtcctctgaagtaacaaccatcccatctggctgagaagtgatggacacggctccttaaccacactgtaccctctgtcttggcacctctctaccagaaagatatcaacaaattggatggaattcagagaacatgacttcctattatccttctcaaagttattgctgcagaggaaagaagcatacatcttttacccaccaggaaacccccaaagcatctattaccataatagccatgggaaacagaaggcacctcaaataaaggtggggaaaagaatgaaagaaatggctttggcctgtgcctgtttgacctctgagagatactttttgcaagaaattgttaagttttggcccaaaaagtggtcggtcttttatccttccttgtggaggccaaactgcaaaccaggatgaagaaaccatcagtggcagtttggggaggtggaggagggactatctagactcagtgaatcaccaaggaaacatgaggcctatttctctgtgaagctgaacttcaaaaaacaatctaagagatacaaagggaaaagtgtgactgctctgacagcaaaaacaagcaaatatctccagaggggattaatccttctgcttcaaagtaactaaaacaaagaaagctgagccagcttcactggaaacaacacctgtccatcagacaaggatgagctaatcaaaagaaaacactgcctatgtgcacgactcagcagcctggacagctaataccaaggaacacgttttcactataaagattcagctttcaaaatccagttccctcttgtagagccacagggttaaaagggaccttagagatcatctacatacaggccaaaccctcaatgaatgccagtgttcgccttatgttcttcttgccggactcttttctggcctctgttctgtcaggatgtttcctgttttgcaaaacagctttaatccttgagtatatttaattgttagaaaacagttcctcaaatttgaccccaaatttaagtctaatttatgaagaaagttttgcctttggagacaggtttaattttacttccatgtggaaaaccttcaaataaaatgatgactattgtgtactcacgaaaaa

SEQ ID NO: 265207 - DNA, 1767 bp, Homo sapiens
ttctgttacacaaggggtaccaaagtccactctgagcttttcctctgggaacagatcccagattattccagacttaagacatggagatatatcttgctagaggtaggaagatgataagatcagtttctataggtagaggataatgtgtcctaaaatgtaggtagagataagtctgacagtggtttagacaaaaagggcctctgctaatggtggagagatcaaggaagaaaagagcaacgttaaagtgaggctgtacccacagatcatgctcaagcaaattcgaaccgtgagcgcatttctcttaaacaatgaacacttagaataaaaattaaaatttcccacaaatttctaattttaaaatagtttcccaagatttcagtggtattgtatatatgcccatataattttttggattactattcccacaagtgtaagatgaaagaggacctgccctccattctatctactccctctctgcaaaggccattttgaagatctcagttttactgaaaggggtctgccacacataacttccctggtgtaccagcaacaagtgttcagtggaccatggcaacacaaagaatgacggaggagagaaaatgccatgcagaagtgatagtcaagatgaagatgtgggagaggagcagcccccagtatatattcagtgtgtcctctgaagtaacaaccatcccatctggctgagaagtgatggacacggctccttaaccacactgtaccctctgtcttggcacctctctaccagaaagatatcaacaaattggatggaattcagagaacatgacttcctattatccttctcaaagttattgctgcagaggaaagaagcatacatcttttacccaccaggaaacccccaaagcatctattaccataatagccatgggaaacagaaggcacctcaaataaaggtggggaaaagaatgaaagaaatggctttggcctgtgcctgtttgacctctgagagatactttttgcaagaaattgttaagttttggcccaaaaagtggtcggtcttttatccttccttgtggaggccaaactgcaaaccaggatgaagaaaccatcagtggcagtttggggaggtggaggagggactatctagactcagtgaatcaccaaggaaacatgaggcctatttctctgtgaagctgaacttcaaaaaacaatctaagagatacaaagggaaaagtgtgactgctctgacagcaaaaacaagcaaatatctccagaggggattaatccttctgcttcaaagtaactaaaacaaagaaagctgagccagcttcactggaaacaacacctgtccatcagacaaggatgagctaatcaaaagaaaacactgcctatgtgcacgactcagcagcctggacagctaataccaaggaacacgttttcactataaagattcagctttcaaaatccagttccctcttgtagagccacagggttaaaagggaccttagagatcatctacatacaggccaaaccctcaatgaatgccagtgttcgccttatgttcttcttgccggactcttttctggcctctgttctgtcaggatgtttcctgttttgcaaaacagctttaatccttgagtatatttaattgttagaaaacagttcctcaaatttgaccccaaatttaagtctaatttatgaagaaagttttgcctttggagacaggtttaattttacttccatgtggaaaaccttcaaataaaatgatgactattgtgtactcacgaaaaa

SEQ ID NO: 265208 - DNA, 451 bp, Homo sapiens
cccctacaagttagttaagttttattgcgaaggaaagctgcctggctttatctaaaggtgttagatcaatcataatcaaccccaaaatgccttaaaccagcatctctcttagggagagcgaggagggacgtttctaaaaggggtctcttctagggagcatttccagctgtacaggccatattaaagggcttggatgaccaagtattatattattgtttggccaaaaaatatgttctctctgctttggtaagtggcttcttaataatgcacagccgaaaatagaaatcaaatgcaaatgcaggagtgaggcagaagccagttgaagaggtgacccaggtagatgtgtttaaatctgagggcagatgcatgtgtgctatttttaagtcacggaattctcttcacttagctaacagtgctattatttgtttttcagacttgtgaacaaatctga

SEQ ID NO: 265209 - DNA, 459 bp, Homo sapiens
ggaatccccatgttggtgagatagaggtgggttcctcatcgtttttctttcgggatttcaagaagtggttctcttgtattcttatgccacgtataataacaatttatatcattaaatgttttcccattatcaaaagatgttcatgcttatttttaaaacagaaataagaagtaatacagagaaaaagaagaaaagtcttccattgttttacaacccaaaaataaccaccatttttgggagacatttgtttccatttttacttttatagtattttgttggtgtgtgtaggaagtaatctgggcgttttgcccagtttggtttaatttttgtttatttgtgaagtgtcttagattgcattacacttattagatcattactgttattagctgttcctaatgatacatcataatgtgatcttatcaatctaaaattgaagcaataaaaagttcattccctaga

SEQ ID NO: 265210 - DNA, 418 bp, Homo sapiens
aaactgctagcaaaatgcatgtggaaaccaagggcttggattttgctgtactgggtttaccggttctctcacaagcgcctgtgatggaaactcatcgacaattgttcttggttggaagaaggggctgagagattgacaagaaacaccgctttctggtttcaataagcttgaatagccctcaaaataaggagaaggggacactccttccttgggggagaataaaatctcactctcccctgcctcacccgtccccaccgggcacgaaccggcgcctccgtggtcccatcacccaagttccccacctcactggggagaagcgccctttcccggcacccacaccaaacaacaaacccgacacggcctttgaggaaagcgggagccgccgcctgggagagacgcaggggcccaaggcgcaggc

SEQ ID NO: 265211 - DNA, 357 bp, Homo sapiens
tgcttccttccagattggtaattccatcatggctggacattagaatcatcttggggagctttaaaagtcatgggcggcaggagagacagctcatgcctgtaattccacactttgggaggccgaggcaggtggatcgcctgaggtcagtagtttgagaccagcctggccaacatggtgaaaccccgtctctactaaaaatacaaaaattagccgggcatggtgatgggtgcttgtaatcccagctactcaggaggctgaggcaggaaaatcgcttgaacctaggaggcggaggttgcagtgagcccagatcacagcacttcactccagcctgggcgaaagagcgaaactcccatctca

SEQ ID NO: 265212 - DNA, 431 bp, Homo sapiens
tattttatatctctacttgtaatcccttgccccagacacctgtgagcttgtcatcaccttgtagcttttatgaacagcgtcaaccacttttatcacttgcattcggagttatacaaaacagagatgagtatcttgtgtcaatctgtcagatgtccccagacaggttagaaacataacataatgatttgcagtgaagtctgctctgttccctcttatgcaatgggaggtgggatctggaaccaagctgccctctgctgaagacccagattactgctgtactggggagtggagagagtaagagtgaaagtgccacacacctttcctactattgtgacaatagctttttcttgatagggcatttgctggcttgctgtaaacctgtgactgttttccagagatgctttaaagttggttcagataacttctgggct

SEQ ID NO: 265213 - DNA, 407 bp, Homo sapiens
cctctcttaagctatggataaataatgattaaactacataaagataaggaacaatcactgaatgacttaacctgtcattcccaactctttgtattcacactctagcctttcctttctcccttgtcctttaggattcttcaccatcctatgtgggagccagctttagttcctcctgcacgaggccagggatgtgtattctgtgcttttgcaccctcgttgctccagtttgaatgcctattctgcatagtcagaactgctttccaactagttttcctgtaaatagtctccctatatttaatactgcctaccccccactgctgacagggttatcttaataaaaagcaaatatgattacactctttgtcctcctaatagcctattctgactctcaaatgcccacaggataa

SEQ ID NO: 265214 - DNA, 1101 bp, Homo sapiens
ggaggggcagcaggagttgacagtgaggagggttgggatgccagaattggtggggggatggagggaccttgtgccaaaaggggtgtggggaggatggataataaagcccttggggtaaaggcagggcagggacacttactggaagcctacctcaccttttctaggtctgagaaaaagacctaagggcctggagtagtagggataggaggatgtggtgcagaagtcgggacagaacaaacagcgacacatgcgatgtcattaggtagagtgatgtcttggtcactgcaacatggtaccaatagttccagcctgtgtgggggtgcagtctgcaaaaaatgaaaataagcatgcatgttctttccaaggatttttacactcattttaagtatacagcttgatgattgtttaaatatgtacacaactgtataaccaccactcaaagcagatagagaacattctccgcatcacataaagctgcctcctgccccttcctagtccatgtagcccccagctggggacctctatgctgacttcatcatcaattgtgtctgttcttgaactccatctctctggaattctacagcatgcactctttggtctggcttctttcatgcaacataatattggatggactcatccatgtcactgtgtaccaatagtttcttttcttattgctgggtagattccatcatgaatatgctacagtttaaccgttctaccattgatgggcacttgggtcgtttccaggttggaaccattataaataaaagtgattacgcgcctgcccctttaaaaacagattatctcattctctcgctgtctcttgcacacatacaggccctcgcacaggtgccagagcaggccagcctcctctgggaggtctccccttgcccctcaatgctgatttcctcatggctgggggatgagggctccgggctgggagccagggtgggagcagcgataccctcttcctaagactcatcgcgtctcttccagcctcctcgccccaggccgcgggcgccctgagccttcctgaccccgcagggggcctcgcccgcggtcccccatgagcgcgcccggctgaccggcggggcggccgca

SEQ ID NO: 265215 - DNA, 549 bp, Homo sapiens
cctttctcttcttcctcctctccattcttttaggcacagagcattccttttaacattgccgtttttcttaatagctagataagcccaggtatccagtaagcccccaaaggagacttggtgtaagcagacctggtggaacaaacatccagaccatccagacattattatgagttttgagtggccagtggggctccatgtgctttatgtttggattatttaatgtttttcccgtcctttaatgttaggtctcttcagccaaatgataaggttgaacagggcggaaattacagggtggggatcacagtggcgttttagcataagccttcgcttccattcatgtttcagtggtttgaaagagttgtttttttattccacccttttgctttatgtttttttgtttttgcattttatttaccgtgcttttcgttcatttgtttcatcttatctcttttcttccctccactggatcaatagcattttatttccttttttcagtgtttgctttttaaaaaaaaattcatggctgatgtttaaaattctgatttccca

SEQ ID NO: 265216 - DNA, 364 bp, Homo sapiens
ttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatag

SEQ ID NO: 265217 - DNA, 461 bp, Homo sapiens
tcatttattgattctcctcttatagaaaatccaaataccagtatgtttcttatctactgaaaacagaaaattagaaaaattgtgaaggacataaataacaaattgaaaataaaaagactttcctgaatacaaaaagcaaggtgctctgagaagctaacaacatgtcctttatgggagggaaaattttcagagtggctgagtaagttttgaaaagaagagttacgtgcatcaaaaattcagttcagatttggctttctaaatatatttttagcttagaatatttatgaactgagacttttccaaaaatacttaataaaatactggtcaccaccaatcttttgtaaataattagtagattatgaaagagactaatgccagatccagatgtatttgtccactctgaaatctatgaaccatgatctacactgagtttggacttgaaaaggcacagcatataggtt

SEQ ID NO: 265218 - DNA, 409 bp, Homo sapiens
gcggttttgaaactcagtgagcaaggcgtcttagacaagctgaaaagcaaatggtggtacgataaaggggaatgtggaagcaaggactccggaagtaaggtcagtcaccggctacagaggtcacgcacacctgtaacaaaaatgcacagtgttgaacagtgtcctccgagcctcagagaggcttggaggccttagagagctgggccccagcagggccttgatgtccaagagtccaggcagggttaaaaagtttgaatatcagcacgccagtgtttcccaaccccatggaacctgatcctaccccttcaaaaggctccattatccactgtgttctggtactctttgctgtgggacagggccgtttagcacacaacccaggatggtccttttggctacccctaattattta

SEQ ID NO: 265219 - DNA, 327 bp, Homo sapiens
cagccaggcatcagtggagcacagcggaaatgggtccaaagccacccacagaggctctgtgtggttcttggataattctggaaggctctagagaaggcaacaagaaggcaggaacccagggccagaaactggacaacttgtgtgtgtttgtctgtaaagtggggctaggaatccgcgtgggggtcaaatgagaacagctctgcctcccagcgcacagtcccgcgtcgaggtcagagagcctcttaggccctggctcttttgggaaatcatcccaggggctaaagacaaaactgaagttgaaataaacatgggggtccaaacactcca

SEQ ID NO: 265220 - DNA, 532 bp, Homo sapiens
acaggggattaaggggcgtgtggtaagaggatccatttcaaagagctggtagaagatgatcaatgatctaggaaatcagagttgaagaaggaacatcagtgccttgaaatgttccctagagctctgacccccacaagggttttaactaaatggctacttagtttattggatttacccacatagcacatatttaaatgaaatggatggaggaaagaacctctgcactacatggcagaaaaatgacaaaaagcttttgaaggtcagggaacatagcacaatcactttagactggtgagaaaatgaaattcttctcaagaccttgtagacctgatggtgctatcaattttaaaaccagtgtagtgctgtgggaggcgtgtgtttcatactaagtgacttgtactgaattgtaatagctttgagcatccacttgagaccttaatgaatgagttacataaaatgttaatatcattaatgccagagaaattatttatttattactatcatcacatattacaaagcagagctaccaaat

SEQ ID NO: 265221 - DNA, 645 bp, Homo sapiens
tgttaccaatctaagtggtaggcacacctgtgtctgtattgttgtgtttttcaaaatttttcaaaatataaattaactgcaactgaatgtaatgtatgagatgagtaataaaaccttgccttaaaaacagtatttgatacgtggctggacaaactggcataaacacatcatgcatatgggaatcaccattatggtaggaatcaggcaggaaactgcattagggtcctacttatttataggggagtgtaattaagattactcttcattccatgttttcccaacagtgttagtctcaccagtcccttttagaaccagtgacacaagcatataaactgtttttccaactcaaaatgcagtcaaaatgaatataaacttctataaacaccaattatatttacaacatgcacactcacgcacacacatgtgtgcatcacaatgaaaaaataccctggacccattatcaaaggaccatagtttaaaaaacatgttaatttgtctttccaaaaattactacacaatctattacttctcttgttatataacagtttttctaaatatggctttataagcagatgttcatctttcatgacttcttcttagtaatattagatttatttcaggcaataattacaattaatcatcata

SEQ ID NO: 265222 - DNA, 517 bp, Homo sapiens
aagcttggtggtatgtgcctgtggtcccagctactggggaggctgaggtgggaggatcgtttgagcctgggaggcagaggttgcagtgatcaggaattgtgccactgcactccaacctgagtgacagagcaacactctgtcttaaaagaaaaaaaaaaaagagagagatagtaatctcttgggcaaaaggtatcaaataattgaaagaaaagtttaaacacatttccgagaggcagggcaactaataactggtcagaaaaatttagacggtcttcattttaaaattggcatcaggaaggattaccatgaacttattttaaatccatattgtaccagaatgactatgtctgtgtttcttaggaatgttgaagctttttgtgaaaactgtactgtatacatatataaatatacacacacttacatgtatgtattttgatagatattacatggactaaattttgtcaatttcatgtaatttaccctttgcaataaaaatgattcattaaatatataacta

SEQ ID NO: 265223 - DNA, 342 bp, Homo sapiens
tggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgt

SEQ ID NO: 265224 - DNA, 363 bp, Homo sapiens
aaagacggtgctttctgcactcagcttgaaggctttctactctagcatcacatctggcttgaatattaagtattgctttttcttgattgtcagctttgttgcgagcatcatccagttgctgttgaagcaacatattttgtttagttgacaaaatctttcctgcttttctatgcatttttccattgtactgtatccacttttgtacattttttcagtgtccttcattcaactctgtttttgctttagctcactttgcacgtgttcaaaaaccaaagccttttctttcagagcctctcttgtgtaatggagctcagtttcgaggactctggacttactctcagctttggaaagttgcagagaaag

SEQ ID NO: 265225 - DNA, 595 bp, Homo sapiens
gagaaagatagaggcttataaaattttggtatcattggtaaaacttagcttcatcatatactctgcaatatttaacatagttaacaactatcacagataagaccaaaggtcagtttacaaacatctacactgcaaacccaagggaaagtgaatttatactagaataatgaaacactataaaaatgttctttaaaaaacttggagaatgttattttatggaattctctatagaataaaatacaggatgtaagcagtatgtaaggaaacaattcaaggagaaatgaaggacaagatgggtttgaaatatccactaactctcaacctctgatcactaagtcagatgcccagtgtgaatccctgaagttccttttgagcatcctctgcttatccattgtgccttcttctacattttgccttcattttacatgcatggcaggagggaagtataatagtgagatagaataggcgggctactcctttattctaaaggctgtaattcttacagcaaccaatatatgtataaaccattgtacttgtccaaaaatgccaataaattttaataaataaagcatgatcacttccagaaaaaaaaaaa

SEQ ID NO: 265226 - DNA, 312 bp, Homo sapiens
tgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaat

SEQ ID NO: 265227 - DNA, 308 bp, Homo sapiens
acagttgacccttaaacaatatgtttgaactatgtgatgcacttacatgcaaatttttgttaaccaaacgtggattaaaaatacagaatgggccgggcgcggtggctcacgcctgtaatcccagcactttgggagactgaggcgggtggatcatgaggtcaggagatcaagaccatcttggctaacatggtgaaacccgtctctattaaaaatacaaaaaattagccgggcatggtggcaggcgcctgtagtctcagctacttgggaggctgagacaggagaattgcttgaacccatgaggtggaggt

SEQ ID NO: 265228 - DNA, 1223 bp, Homo sapiens
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaacgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaatatatgtactgactacatacttttaatgaacaagaaaatccatcctctggtaggttagactttacactgtggtttataatataagcatatttataatacattaatgtttttattaaagacttgtt

SEQ ID NO: 265229 - DNA, 625 bp, Homo sapiens
tccaactacacacagagctcaagaggaaaggccacttatggtcaataagcatgagcatattgatggtggccattagaaaaaaaaaagtgtaaatcaatgtaagtcagtctcccactatcagaccagtcatataaatcactctttctactaaagaaaacatcaagtgagaagcaagaaaaaggttaatggtttctttgcaaaatcatcgtttgagtctaagttcttgttttatgaactaaacagaagatggaaagggggaaaggagggtttcccttataatcgtaagaaggtcagtaactttcagcagattacccgaatttataccatgaactgaatgttattttttaattaacgattataaaatctgcatcctacttaataattttaatagcactgttctttgtttctttcctcagactttgtggtagattcattcctttatttattaacagatactagggatacagtggtatctttgaagaaagcaagatatttcaggaaagaaacaagtgagcaaagagcttcaatatactgtggacaatgctgcagcagaggagaaggatgagaagtctccagaggtggtgatacttaggaggccaagtgggcagaatacctggtcagggtt

SEQ ID NO: 265230 - DNA, 797 bp, Homo sapiens
gttttcattatcataattgaatttccaagaacaacttgatatcattcagctgtccaaaaaataataagagcattcattaaatactgattttcttaaacttaaatgttgtatttcatatttatttatataatacaaatggaaatcaaaactgaaatagcctccctttagaatgtcacatttttcttagaaaacattttggaattggttaaccttattgggaatggataatttagaaacaaaccaaaaaaaaaaaaagatatttgaagtgtttttataggagatgtatttttatcatagtaaatgatcacaattttaaataattcatcttacaagtcaggtaaaataaaatcgattcccagattccatacattaggagtgcaaagacaggatcatacacatgacttatacctctcatttaaatattttatagtataaagtatttatggaaagggtttgagatagatgatttttgggaaagggcaaaatgtgtcagatgccctagttaatcatgtaatttaattctggtattgtgagtggttagcaatcaattttgaatttataattctgctattttaaaagaaatgtagtcttgtagtatgaaataattaaaaattgttaaatgtatattttggttgtattataataaaatgcaaacatgactgttctatgattataaaaactactggtttgtgtgcaaattttgttttcaaaccccaaatacagtaaattttatatataaaataggactaaagaaaatataagatgcaatattttctgaaatgttcagtagatgtatt

SEQ ID NO: 265231 - DNA, 590 bp, Homo sapiens
atcgggaaacatcactccctccctcccatcagcaatcagatccaggagtgcttagggccccattacagccaagtcccaggtcaccctctctggtccattcccctaatgctgcccacacctttgtaaacgctctcaattgccctgtgagacagcgtaccatctgtttcctgccagggcccgacgcatacagggtgtgggcaagggtttgtgaaatgcagggtcttagagttcacccagttcaccttcccttttaaaaatgtttcactttagagacaggctcttgctctgtcacagaggctggtgtccaggggtgccatcatagctcactgcagcctccaactcctgggctcaagcgatcctccttccagagcctcagaaacacctcagacaccttattctgttttttctacctacaatgctcacccctacaggttcttaaaaaaaagcagcaaataatattgccttgatccctgacagcctgtagagctaccaacaagagagcaccaggaatcgcccacttgtacgatacatgaagtcctacagtggctctggctttctggggaactcacacctttatcaagagcctatat

SEQ ID NO: 265232 - DNA, 999 bp, Homo sapiens
gcaccactgcactccagtctgggtgacagagtgagatcccatttaaacaaaaaaaaaaaggaaatcatcaatgcattgtaacagggtagagttgtgggggaagatcatgccccttaaatcagcttgtaaaatgtgagaaaaacaagtgaggcaatctgtatccctggagaaggactgtgcaggtgaactgtttgcctttccacgtgaaggcaaagagaaactgacttcctgggttgacagggatgctgaaagaggtgccactgagatcaatagctgaggaacatcaagtgtcaacaggtgtgttaggattgtatgtgggtctggcgtagtggggtgctgaggtataacaatattgttaatggctcttaggtcttgagacctccatccctttccatttggtttctggacaggcagtatgggcatgctgcaggggctagtgcaagggactatgaatcccttggagaggaaatcattaataatgggctgtctaccagccaaagcttcaggattgaggagaccctgccttacattaggtagaggtttgttggggtctaaatgtatggtaataggtggtgctgagtgaattagacctacatcagtgttagatttagccaagtgtatcaggcggttctcttaaagccaggtgctgagtggcaactgagtaattagtgacagacaagggaaagacatgtaaggtcaattgatacggtttctgaaggagagacctgcagaatggtatctccctaatgagaaaaagaaatatgagcctggtcagatgtggtggctcacgcctgtaataccagcactttgggaggccaagcgggctattcccttgagcccaggatttagagagagaagcctgggcaacatggcaaaactctgtctctataaaaaatgcaaaaaaaaattagctgggcatagtggcatgcatctgtagtcccagttatttgggaggctgaggtgggaggattgattgagcctgggatttcaaggctgcag

SEQ ID NO: 265233 - DNA, 2985 bp, Homo sapiens
gtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcagctgtcaagaaaagtgaaggatgaagccaccatttcttttggcccttgtggtctgttctgtagtcagcacaaatctgaagatggtgtcaaagagaaattctgtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacagctttactcacagacaagcctcccaagccattgttccccatggagaatcagccaagtgttatagatgtccagctgggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg

SEQ ID NO: 265234 - DNA, 417 bp, Homo sapiens
caaaaatgactgtgctggggcagtggaggacacaaaaatgagacacagttcctgtcctttagcagcttgaagtcaggcttgatgtcaagtagaaggtgatgagaaaaagaaaaaaattgcccagaggccaggcacggtggctcatgcctataatcccagcaatttaggaggccgaggtgggaggattgcttgagcccagaaattcgagaccagcttgggcaacttagcgagacccatctctacagaaaataaaatatgagctgggtgtgatggtgcatacctgtagtcccagctacttgggatgctaaggtgggaggatcgcttcagcctgggaggtgaaggctgtagtgagccatgattgcaccactgcactccagcctgggtgacagagcaagatcctgtctcaaaaaagaaaag

SEQ ID NO: 265235 - DNA, 287 bp, Homo sapiens
atcagatctcgtgagaactcactcactatcataagaacagcatgggggaaaccaacccccatgatccaatcacctcttaccaggtccctccttcaacgcgtggggattacaatttggattacaattcacgatgggatttgggtggggagacagaggcaaattatatcagtggtggtccactgaatgagaggagtgaatgagaagggattattaagggtatctcccaggcttcccagcaactgactgcaatcccctaaatagaggactctggtagggtaggtttgtca

SEQ ID NO: 265236 - DNA, 511 bp, Homo sapiens
aaaataactaccaatgattgcaagtttttctaatacgtgattggttggtgccagctcttggtagtaaaattgaatcagtagaatcagcaaatagttccaaaggtttttactgaaaaaaaaaagctctgactttttaaatcagggactttgaatatcaactgagtattagattatattaaggaactatttcaatcttgacggatgtgataaggacaccttatgtaagaagatcgccccattgttagatgcatactctgtacaataacatatgctgtctgaaacttcattgaagatacttcaggaaaaagaagtgactatagataaaacaaataggacagaatagtaatggttagtgatggctggtgaaactcggtgatgagtccaaaatgctcttatattccccagttttatttatactcaattttcataatacaaaatagaaaagagttctgtggtcaaataagctttgagaaaccctggttttaataaaattaatttaggcatttttaaa

SEQ ID NO: 265237 - DNA, 854 bp, Homo sapiens
tccaattccctttttttttctgtgacccattccctcacctggcaataaaggatctttcctgcttgattgacatgtgcaaatggtaggtgaaccccttgattccatatgtctccctcaaaatcactttacatcctaaggccaggatttggcccctctccctagggccactgaagttttagctattccatttgtattaaaaactggttaagagctataatggagggtgattgactctgaatcttgacaaatttagaatcttttccgggctattcaatcaggctttgccaaccttcatttcctttatttttcaaatgaagaaaatgaagcaggtaattaaggataaatttcttgtgtgagacaacatggggagcctgtggcacttccagaattaggccaggaatccctctgccagggaattcagtagaaatctctgccaagttatctctttgatgtatatctccgcaattcttatttgctttgaaaactactgcctcctaccttcgtttcagatgtggaaattgaagctgtaataaatgttaagtatcctaaaagcaggactcacatagcaaattcaaggcacaacaaggattctcaatcgttgtgtgtttgtgcttttttctaacaattcctgcctactgccttcctgtgttaagatagggagaagaggactgtggcagattctggtgttttagtgccatatgctctcttcatatgaatgctattaatcatctgattacagtaaattgatttaagtgctggtgagatcaacatctcctgaaatttattaatctatttattgaacacctactgcatacaatgtagtacattaggttcttttgggggaaaatgaaaaa

SEQ ID NO: 265238 - DNA, 204 bp, Homo sapiens
agttgggggcccccccaaattaaaatttgggggccgtttatccttttccccctctcttcatatgaatgctattaatcatctgattacagtaaattgatttaagtgctggtgagatcaacatctcctgaaatttattaatctatttattgaacacctactgcatacaatgtagtacattaggttcttttgggggaaaatgaaaaa

SEQ ID NO: 265239 - DNA, 449 bp, Homo sapiens
gctttttttttctctttaaaacaagagcattaaactgtgaatttttgaagcttctatccagcaaccaatgaattacttctgcagccttctgccctccttgggccattcatccaacagtcagatgaacgtttaagaacacaaccagttcataaactggtacttgaccatgaatgacaaattcatactgatttttttcttctgtcatccacttgcaatatttctctcttattcatactcttcttgtagatatatttctccagcttggaccatctgcttttccccctaaactcagaacctgccatggcttcctccttaccgtcaaaatcagcattcagtatggcctaaaaggtccacatgcccagagttcctatcaaaatctcaaatttttcttttgggttaaataggaaaagaggagactattaacaccagaagtcagaagagtaagattt

SEQ ID NO: 265240 - DNA, 279 bp, Homo sapiens
gcacaaatgaagggtttacgcccaaccaatatctcacattatttaaacaaaccatgtggttttaatctttcttacctttgaacacacttctgccagctattcccagctcccttatctttttatgataatctcttgcatccttctaaactctctgggggtataatcacctttgtgaaatctttcctgaatcccatttatctcttcccatttgttgccaggaactcttccacttgtagattcaacagtgaataaaacaaagttctttcttttgtggagctt

SEQ ID NO: 265241 - DNA, 488 bp, Homo sapiens
acacatggctcaagaataaagcaatcaaggatttttttctttctgtaaagcatatattatatgaaacgtttgtcaggttcttcactcattgtaaattaggcaaggaggaaaggataatacagcattggtatgagaggagagagagggaaaacaggtgcccaaaatggaacaaccccaatgagatggagaactgaaatacagtcatgtgtcacttaatgacaaggatacactcggagaaatgcctctttatgcaatttcatcattgtataagcatcacagagtgcacttacacaaacctgggtggtacagcctactacacacctaggctatacgatatagcctaatgcacttaggctacaaacctgtacaccatggtactgtaatgaatactgtaggcaggtgtaatacaatagtaaatacttgtgtgtttaaacatgtctaaacatacaaaagctacagtaaaaataaagtataaaaaatttttaaaa

SEQ ID NO: 265242 - DNA, 380 bp, Homo sapiens
ggtttcaggagctggtggggacaggaatcagactgaggtgagaataaggttgatggcataaaaacagcaagtggtgtttggcagtgacagggaggagggagagagtgcagggcagagagctgccctgttggagctggagcctgcagggccagtagagtgagggggtgcacaggttgtcagtggcctgcagaggggcaggagggcagaggaagctccgtttgtgggtctttagacataaggaagttgagaaagattgtgcccaggctgggcgcggtggctcatgcctgtaatcccagcactttgggaggcaaagtcaggtggctcgcttgagctcaggagtttgagatcagcctgggcaacatggcaaaaccctgtctcta

SEQ ID NO: 265243 - DNA, 319 bp, Homo sapiens
tggattttttccattgcatgtaataagtattccaagaaaactgtattagtagcagatataagcacaatactttctctcaagggttaccttatatctttaaaattttttatcatgacgataactgctgaatatatttatcttaatttacaggatttcttttactggggaaaaataaatttaagatttttcctgctgccctgatgtcctgtgcaccaaagaacattatcaagagagctaaaaagcaactcatagaatagaagaaaacatttgcaaattatgtatcagataagggcctagttaccagaatatataaataact

SEQ ID NO: 265244 - DNA, 445 bp, Homo sapiens
tatgtggtatgctagcgactagtgctaaggagaaaaactaaagccgagagggagacagaccccatgtgtgtttgtggcagggtggggtggcatggtgccttggatgggaggccagggaatgccttgctgagaacataatatttgagtgaagacctgaagaaaatatacaaatctctagagattccctatatgtccatcttgggcaggaaaattcttgcctcctctttaacaatgtgtactacctgagggtgtgttatgttctggagcagagggctctgtggggacacatggatgctccctgccctggagaagtatctctggggtaacaagtcctcagccctttagctccttgaagtctagcagagggaagtgctaaatgccaggtcataactgcaagtctgcaggtgggatccttgagggctggagtggcaaggggaaggtgaca

SEQ ID NO: 265245 - DNA, 798 bp, Homo sapiens
tcagacactcggctccacctcactgagtctctcaggcatgtgcagggtcctaggaagcatatgaagtgcatcaggaaccccctcctgcccccgttgccgaggcagcactgccctctgctaggaacagctccgtgttggcctctctgtccccacacactgggcctgcagggcttctccgagactcttcagttcaggcttctgggtgctttccttagttcagcaccagtgctctgtgtgggcagcgtctcccccgaggatccgcagctccgggttacccgcaggcgtccatctccgggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaggacaaaaaaaagacacaacaaaacacaacaacaaacaaagacaaaaaaagcaacaaaaacaaaagacaaacaaaaaagaagaaaaacgcacacaaagaagagagaacacaagagacaacacgaaagcgacaacacagagcaaagaaaagagaaggagagggaagcacaacacaagagg

SEQ ID NO: 265246 - DNA, 698 bp, Homo sapiens
tcagacactcggctccacctcactgagtctctcaggcatgtgcagggtcctaggaagcatatgaagtgcatcaggaaccccctcctgcccccgttgccgaggcagcactgccctctgctaggaacagctccgtgttggcctctctgtccccacacactgggcctgcagggcttctccgagactcttcagttcagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaggacaaaaaaaagacacaacaaaacacaacaacaaacaaagacaaaaaaagcaacaaaaacaaaagacaaacaaaaaagaagaaaaacgcacacaaagaagagagaacacaagagacaacacgaaagcgacaacacagagcaaagaaaagagaaggagagggaagcacaacacaagagg

SEQ ID NO: 265247 - DNA, 1294 bp, Homo sapiens
cttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccaaagggcatttgcggcttctaggagccaagtaggaggaggctgggatccgtgtttcaggcgggactccaggcttgggcgggcctgatactcgagtccacatgccccctctagagaggaacctgtctcctgccagggccagggaggggggcactggctgcttctgtattttggggtttggggccctggagcttcccatgcggaattgccgtccctcctcctaggcgagtcccagggccaccccatcccacagggacccgggcgccagcttctgaaagcatggggcatctgcggaagaactgggttgtttcccagctttcgtccctgcggaggggcgatccggcccctccatgtcagcagtgtttggtcgtccacatgcttgtcagccccacgctgtgctcctgcgtctcttcccgtctcatccatctggatgcttgacacctctgacagcatccctttcctgtcatcttagggcagcttcaggaaaccgaaaaacaggcttgtgtccttccattaacccctttatccacaagttcagtatcagcatgagccctggggagctccaaggctgcagccaggagccccgtagccagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaggacaaaaaaaagacacaacaaaacacaacaacaaacaaagacaaaaaaagcaacaaaaacaaaagacaaacaaaaaagaagaaaaacgcacacaaagaagagagaacacaagagacaacacgaaagcgacaacacagagcaaagaaaagagaaggagagggaagcacaacacaagagg

SEQ ID NO: 265248 - DNA, 406 bp, Homo sapiens
acacaatagggtgactatagtcaacaatagtttatggtgtatttcaaaataactacatgagtgaatttagaatgttccaagacaaataaatgataaatgtgaggctatggatatcccaattatccagatttgatcattacacattatatacatgtatataaatatcacatgtacctgattaaatatgtataactattatgtaccccccaaaatacaaaatacaaataaatttgtactgacatgttaactactatgaaaagacgtatcttcagatgcttataatagtttgctaaagctggatgcaaatttaagcagcagagggtgagctacttttttttaaacttaagaacatattatgacgacctaggttaatatgcttaattaatgtgaagttcagttttctttt

SEQ ID NO: 265249 - DNA, 708 bp, Homo sapiens
caatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactcttattca

SEQ ID NO: 265250 - DNA, 516 bp, Homo sapiens
catttttgtcttctctcatctcagaagggtgtggggctgattgctcactgatgctctacatcctgccgctcccacatcacctgaaaacttgctccatcatcaatttctcccctttctcctgcgtcttcactctcttggtctctactagatccttcccttcacagatagatatggtgctgtctcttccatcttaaaaaaatgagttctcttggccaggcgcagtggctcacatctgtcatcccagcaatttcagaggccaaggtgggaggattgcttgagtccaggagttcaagagcatcctgggcaacatagtaaggctccatttctactaaaataaattttaaaaaattagccaggcatggtggcacacacctgtagtcccagctacacaggaggctgaggtgggaggctgaggtgggaggatcgcttgaatcccacaggtcaaggttgcagtgagctgtgatcacatgactgtactccagctctgtgtgacacagcaagaccttatctcaaaaa

SEQ ID NO: 265251 - DNA, 1346 bp, Homo sapiens
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265252 - DNA, 868 bp, Homo sapiens
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaagggaattattcgagagtctcacttggaaggaacacacagggtttggctccaacgttatcactttgttaaacacgcacttaactggaacttttttcggcccttggtttcccccacgagtttgggaccctt

SEQ ID NO: 265253 - DNA, 927 bp, Homo sapiens
gtatcaacgcagagtgcccattacggccggggctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaagggtaagttaagaaaataacacattttagcatgtggacctgatttttctcaggaatttttagataaatccccccatatttatggactttttactgactgtagtatcttgttttctttatctgtgaaatatcttctttccaagatttgttaagcatgaaaaatatgtgccccaaagaatgcatggcacacagtaagcctc

SEQ ID NO: 265254 - DNA, 287 bp, Homo sapiens
  misc_feature (91)..(91): n is a, c, g, or t
  misc_feature (100)..(100): n is a, c, g, or t
gtggggcaagatccaaaagcgtagcaaaagagtttgcctgcaaatctttggaaaagcgaaagtgtttttttgaatgaaaaaaaaggtaatnttttttttncaacaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265255 - DNA, 1738 bp, Homo sapiens
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaagaaagacaaaaaaagaaaaaacaaaagaaaaagagaggggggaaaaacacaaaagagggaagaagacagaggagacaacaaacaaaaggagaaagagagaacagaagaaaagagaaaaaacaacagagaagagacacacacaaaacagccaggagaaggacacaaaaacagaagacagaaaaaaagaaaaacacacaaaaggcgaaaacagaaaacaaagcagacacaagcacaaacaacacagagagaaacaaaaaagatgagacaacaaaaaagag

SEQ ID NO: 265256 - DNA, 1807 bp, Homo sapiens
agcccgcgcctgcgcctttgcggcgggattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265257 - DNA, 1503 bp, Homo sapiens
  misc_feature (816)..(816): n is a, c, g, or t
  misc_feature (822)..(822): n is a, c, g, or t
  misc_feature (826)..(826): n is a, c, g, or t
  misc_feature (834)..(834): n is a, c, g, or t
  misc_feature (839)..(839): n is a, c, g, or t
  misc_feature (842)..(843): n is a, c, g, or t
  misc_feature (870)..(870): n is a, c, g, or t
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaagaaatatacgaagagtcatcaacttggaaaggaaacaaagagtgcttttgggcatccaacagttaatcacttatgtntttagngcangcaatctnaactntgnnaaactattattattgatcacatacttnaaaagccaaggtgcccatatggaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265258 - DNA, 1301 bp, Homo sapiens
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaatattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265259 - DNA, 1964 bp, Homo sapiens
  misc_feature (1277)..(1277): n is a, c, g, or t
  misc_feature (1283)..(1283): n is a, c, g, or t
  misc_feature (1287)..(1287): n is a, c, g, or t
  misc_feature (1295)..(1295): n is a, c, g, or t
  misc_feature (1300)..(1300): n is a, c, g, or t
  misc_feature (1303)..(1304): n is a, c, g, or t
  misc_feature (1331)..(1331): n is a, c, g, or t
agcccgcgcctgcgcctttgcggcgggattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaagaaatatacgaagagtcatcaacttggaaaggaaacaaagagtgcttttgggcatccaacagttaatcacttatgtntttagngcangcaatctnaactntgnnaaactattattattgatcacatacttnaaaagccaaggtgcccatatggaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 265260 - DNA, 938 bp, Homo sapiens
agcccgcgcctgcgcctttgcggcgggattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaagggtaagttaagaaaataacacattttagcatgtggacctgatttttctcaggaatttttagataaatccccccatatttatggactttttactgactgtagtatcttgttttctttatctgtgaaatatcttctttccaagatttgttaagcatgaaaaatatgtgccccaaagaatgcatggcacacagtaagcctc

SEQ ID NO: 265261 - DNA, 477 bp, Homo sapiens
aagaaatacaccaaccataggcttaacccaatgcttagacttggatttggaagttaagttacctgggaatagtctcagattgggttttaaagggttgaatggctgatcacagaaaacaggttgaactgaaaagcaagggtggagatcacatagcaaaggcatttgaggaacaagaaagatgcttggtaaagagagtgctcagggtggagacagcactgtgtcctcagcctggtgaatagttaaaacatgggtctctggattatacaacccggggggcaatgatctgaacaagggccacaaactgcatatgaatgccaaataccttgctgcatggacagggcaggcaaagagcttagtctgagtactctggtaatgtataattggggcctgagtagaagggagatactgttacagtacgtagttaagcggacataagcagggcaggagagggcccccctcccaccaggaatgtcaggc

SEQ ID NO: 265262 - DNA, 559 bp, Homo sapiens
cagaacatttttgtcaggccagtatccactcttctctggcatcataatcttagaagagttccaaaggagtaaaggagataatggattttaacaattgggcaagataaggaattaaattgacatgaatgtattaattatccacataaagtagatgaaggagtgttgggaggatttttacacactcaggtatcatcatcatgatgcctcagattttggggacctgaaagattttattaaccttcaggagtgaggacttaaaaggctttcccagggctggcgcggtggctcacgcctgtaatcctagcactttgggaggctgaggcgggtggatcatgaggtcaggagatcgagaccatcctggccaacatggtgaaaccccgtctctacaaaaaatacaaaaattagctgggtatggtggcatgagcctgtagtcccagctagtcaggaggctgaggcaggagaatcgcttgaacctggaaggcggaggttgcagtgaattgaggtggcaccactgcactccagcctgggcaacagagcaagactctgtctcaaaaaaaaa

SEQ ID NO: 265263 - DNA, 972 bp, Homo sapiens
tcccggtcgctcggccgacgatagttgctgacggctgggtgtcaggagctggtgacgtttgaagatgtggctgtgtacttctccctggaggagtgggaaaggctggaagcagaccagcggggcctctaccaggaagtcatgcaggagaactatgggattctcgtgtccttgggatacccaattcccaagcccgatctgatcttccggctggaacaaggggaagaaccttgggtcccagatagtccccgacctgaggaaggagacatcgtcactggcgtctacacaggagcctggttctggacggacgacatagaggaccacgaggaggaagacgacgaggacttcctggcggaggtggccgaggaggagaacgagcccccagggctctggtcggcggcctacggcgtgggggacgtgcctgggacgtgggggcccgacgactcggattcggcgcagactccagaggggtggggacccgacccaggcggcctgggggtcctggccgacggctctgaagcgaagcctttcctgcccggccgggagccgggtgcgaacctgctgtcgccctgggcgttccccgccgcagtggccccgccggccgggaggccggagaccacgtgcgacgtgtgcggcaaggtcttcccgcaccgctcgcggctggccaagcaccagcgctaccacgcggccgtcaagcccttcggctgcgaggagtgcggcaagggcttcgtgtaccgctcgcacttggccatccaccagcgcacgcacaccggcgagaagcccttcccgtgcccggactgcggcaagcgcttcgtctacaagtcgcacctggttacgcaccgacgcatccatactggcgagcggccctaccgctgcgccttctgcggcgcgggcttcgggcgccgctcctacctggtcacgcaccagcgcacgcacaccggcgagcgaccctacccgtgtccgcactgcggccgc

SEQ ID NO: 265264 - DNA, 1243 bp, Homo sapiens
gatagtggtggaggaggaggaggagggtgtggcagaggtagtgcaggatgcgcaggtggaggcggtggccgaggtggaggtggaggcggacgtggaggaggaggatgtgaaggaggtgctggcagaggaggagtgtccggcgttggggacccaggagcgacttagccgtggtggtgatgccaagtccccagttcttcaggaaaagggcctgcaggcctcccgggctccagccactcctagggatgaggacctggaggaggaggaagaggaggaggaggatgaggacgaggatgatttgctgacggctgggtgtcaggagctggtgacgtttgaagatgtggctgtgtacttctccctggaggagtgggaaaggctggaagcagaccagcggggcctctaccaggaagtcatgcaggagaactatgggattctcgtgtccttgggatacccaattcccaagcccgatctgatcttccggctggaacaaggggaagaaccttgggtcccagatagtccccgacctgaggaaggagacatcgtcactggcgtctacacaggagcctggttctggacggacgacatagaggaccacgaggaggaagacgacgaggacttcctggcggaggtggccgaggaggagaacgagcccccagggctctggtcggcggcctacggcgtgggggacgtgcctgggacgtgggggcccgacgactcggattcggcgcagactccagaggggtggggacccgacccaggcggcctgggggtcctggccgacggctctgaagcgaagcctttcctgcccggccgggagccgggtgcgaacctgctgtcgccctgggcgttccccgccgcagtggccccgccggccgggaggccggagaccacgtgcgacgtgtgcggcaaggtcttcccgcaccgctcgcggctggccaagcaccagcgctaccacgcggccgtcaagcccttcggctgcgaggagtgcggcaagggcttcgtgtaccgctcgcacttggccatccaccagcgcacgcacaccggcgagaagcccttcccgtgcccggactgcggcaagcgcttcgtctacaagtcgcacctggttacgcaccgacgcatccatactggcgagcggccctaccgctgcgccttctgcggcgcgggcttcgggcgccgctcctacctggtcacgcaccagcgcacgcacaccggcgagcgaccctacccgtgtccgcactgcggccgc

SEQ ID NO: 265265 - DNA, 270 bp, Homo sapiens
aaaactggagggaaaaaagggcaagaagtcctgtgatggatgacctttgggatccttatttccacctctgcttagcaggactgacattgtctccacaccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaa

SEQ ID NO: 265266 - DNA, 381 bp, Homo sapiens
agtgcagtgtcgtgagcatgtacagagggaagttgacagcggggagaggctttgctgaggaagtggcgtttggaagaacgagaatgagatggggttttgccgtgttacccaggctagtcacgaactcctgtgctcaagcgatctgtctgcctcggcctccaaagtgctgggattgcaggcatgagccaccgcgcccagccagaaagccactgctttatagaccaccacttaaatgcacctggcagcttcatgtacgcaagaactttcctgcagctcctttaaatttaagaatcttttggcaaaatgaagaatacaagcgtgtttcttcttcatatgctttgttttaggaacattaaaaaaatatagttactacaatcagaa

SEQ ID NO: 265267 - DNA, 610 bp, Homo sapiens
actctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggtgaggcctgggcgggaggatggggcagggggagtctcatcgcttgggccccagcttctcccaagtagagccctgggctgggaccctcctggatttcgatgggcttctctgggcctccgtttccccatttgtgacattgaaatgggagtcctttactttcatggagctgaggattaactaggataacaggtgcagtgggtacaggaagagatcccttgcagacttagctgggatgtcgttgctggcaaatgtctagcatttccaggctggtaacttgaactcttaatttgtaagcatgggttatcgtgagcgggaggctaggaacaggggtagggagcagtcagggccagagtggttattgtttttgtctgtatttttttttttgaattatttccccccgtcccctccaccactaccctcccattctccctgaatctgttttgagaattttcttgagaa

SEQ ID NO: 265268 - DNA, 629 bp, Homo sapiens
tatgatacgttcttggctattcccccaggacagggatcttgctttaccctaaaatgcctgattatcaaagtgttatgtgtttgtgcatgaatgcgtttttaggtggggggagcagagaggaggttcatagctttcacattcttaaagagttccatgatccaataatagcttaagaactactgttttagattttttttttttttttgtaaacattttttactgcttccataaaaagctggtttcttctctcattcttaccaacaggtgccagcacttcgctcatgtaaagtgacactagtgggggagagaagaggccaaggcgaaatggacattgactctaacgagctgactgtcacttaatgcacatcctctagaaaccagacttcctcaaaatcgagcatcgaggtgtactgaggagtgtggtgcagcaggcagagttaacatgcacacaagctcttccagtcaggcagaattctcaatgtatccagccatctggagcctcatgggatcagagagcagcctacatctccagaaaggcattcagctaacaaacaggtcactgaccttgtcaagtgaccaggtgtccctgatgcattgtcacccgcagttaggaaattctccctctcctg

SEQ ID NO: 265269 - DNA, 283 bp, Homo sapiens
tatgggttgaactgtattccccaaaaagatagattgaagtcctacccccagtacttcagaatacgaccttatttagaaataggttcattgcagatgtaattagttatgatgaggtcacactggaatagagtggacctttaatccgatgtgacagccctccttataaggaggaaaaattgggcacagacacagaggaaagacagctacgtgaagatggagaaagaaattggagcaatgctgccacaatccgaagaatacctggggtgaccaaagctagaagagg

SEQ ID NO: 265270 - DNA, 254 bp, Homo sapiens
cttagcctcaggttggaagctgcctggaagtcgggtttgggggcctttttggaacttggtagagtcatggcaagtggaaaacactgtccacgttagaggtttacttagatacccctccgttcacaaccttacctgcctctccctgacttcagccacagctactgcctgtttttgatcaggtagcgattgttctctgcatcacttattctgatctctcaaaatgcagagcccagcctatcacacttcacgaaaac

SEQ ID NO: 265271 - DNA, 588 bp, Homo sapiens
aattgattttatttaatccaaaaagatatgcagtactaattaaatatgattagagatgcagtagggtcaggctaggcatggtggctcatgcctgtaatcccagcactttgggaggccaggagtccaagactagcctgggcagcacggtgaggccctcatctctacaaaaatctaaaacttagtcaggtgtggcagcacgcatctgtaatcctagctacctgggaggccaaattgggaggatccctggagcccaggagtttgaggctgcagtgagctatgaccatgccactgcactccagcatgtctcttaaaaaaaaagaaaaaaatggtctgtaaagaaggcacaaggagaacaccacgtgacaatgaaggcaaaggctggagttatgcagctacaggctaaggaagtcaaagatggtggaagccagcaaccaccaagagggagggagcaccatggctccaatattagactcccaccccacagaactcagacaacacatctgttgacttaaaccacccagcttgcggcacgttgtcatagcagttctaaggaactaatacagagaaaaataaacatttcgactgtta

SEQ ID NO: 265272 - DNA, 487 bp, Homo sapiens
tcaagagctcgtgtgtgacctgcagacatgcagtttcaggagaatggcgagggcagaagccagattgcaggggctggaggagtcagagtagaaagcagcatgtgtgggcctgttatggagagtcctacaccacaagttcacagggggcttttacttggttgtaagcatttttttttttttaactcttaagaagagtaccatagggctggacgcagtggctcacacctgtaatcccaccactttgggaggctgaggcaggcagatcacctgaggtcgggagttgagagcagcctgaccaacatggagaaacctcgtctctactaaaaatacaaaattagccaggcgtcgtggcgcatgcctgtcatcccagctactcaggaggctgaggcaggagaatcacttgaacccgggaggctgaggttgtggtgagccgagatcgcgccattgtactccagcctgggctacaagagtgaaactccatctcaaa

SEQ ID NO: 265273 - DNA, 371 bp, Homo sapiens
gcggcccctactactactaaattcgcggccgctcgactcctgggcttaagtgatcctcccagctcggcctctcaaagcgctgggattagaggcttgagctactgcattcggcctcattttttacatgtacatttaaaaatgggactttagattcctggttctcaaattggactgcatatcaacatcacctgtagggcccattcaaacagaatgatttttactctcagagtttctgattccacaggtctgggctggggccggagaatttgcaccacaagtgcccaggtgagtccggtggtgctggtggggcactcagtgtgtgctgagaccactggcttagatcaccactctcactggaaatcagagtccct

SEQ ID NO: 265274 - DNA, 396 bp, Homo sapiens
aagaaggagccaatgttgttttaaaattttagcttgagagataggtggggaagaaattaaatagacaagtaatcgctattcagaagagaagggagagtcattgtacgaggcccaagatacttgcccaaaaatatcgcagagaaaaactagtctttggggtcctattttttgagtggaacatttgagttatttaaaattagaattttattttggtcagattagaatttctagggtatgtcatatgtgtttttaaattgaaagctcttaaaactcctattgtagtttaatgtcattatccattaatttacataaatctgatttggatctctattttcatcgtagactgtgtaggggcaatttttcctaaaggttctgtgacatagtgctacctttttt

SEQ ID NO: 265275 - DNA, 173 bp, Homo sapiens
ttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggt

SEQ ID NO: 265276 - DNA, 364 bp, Homo sapiens
aatcatcatgaagatcccctgccttggccttgaccctggagcttaggccgttccccagagcccagtgaccagattaataagagtgaaggaagggttctttgtcctccaccttttctctcaggtgtcaggcatagcgaagggcgtctgccccacccttgcctggcagggtagttgaaactggtttgtctctcacttgttaaaaggtgactgtacagtgtggatgagggaggaccttatttcagacaaatgaaattgaaatgttgacacctctccaatacagacttgcttcacttcatcgcttcctttctacttggaagtctatgttatttctgaactcattaaagctggaaacatcctgagagag

SEQ ID NO: 265277 - DNA, 451 bp, Homo sapiens
ggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaac

SEQ ID NO: 265278 - DNA, 467 bp, Homo sapiens
aatggggataatagtagtttcccctgacattagggttaactggggttgtgtatgtgaagcattgaaccgaatgcctggttcctacatgaataattgctcaccctcttgacaattttcttttaattcatgatctcataggctatttcttttgggaatatagtgaaacaaatttcagataaaaagagcaaaacatacaaaacacagtggtaacagaatggattgtgcatgttcaaaaccattaatcccttgcaaaaagtaactagaaaatgtttcctctgatttcatcccatcctaaccactatatttgagtgtgtatgtgtgtgtatctatcttctatttatccctaaaacccagacagtattcatctatatattttaattagtaatagattccttagtatcagtatgtaaatgagttaaaaatgcaactttataaaacaaataaaagattgaaaccatccttcttat

SEQ ID NO: 265279 - DNA, 498 bp, Homo sapiens
tacatgtgacagtaattgtgtattagttctgtaattgtcattttgaaaacccatgaagtattgcttggaaaaaaatgtcactagtgataagacttaattgcaagtgaagtctgttttcaactgtttgcagttagaagcaggtgttgtaacatctattaaatgattttataaatcttgggttttatcacatttgattaaatgctgctaagccactgatggtcaattccagaggaaaaaaaaagtttaatgactacagtttataaaattaatcaccaggcaaaactacatatttaaaatgtcaaaaggcttgaatcatgaaaagaattcctcaaccttgttaccaaattattgttttcaggattcacaaagcatgttatatatccatttatatttcagtttatacatatgactggtttctattcctgagacttaagtaagtacttggtgcgctttttcttttgttacaggtcagaaataaatcaggataatgaaaaatag

SEQ ID NO: 265280 - DNA, 311 bp, Homo sapiens
atttgaggcccgaagagaaaagaactaaaaggcagcagatgttcacttaaccaagtcacacggggtagattttacagaggaaagaggggccttcagctagacactcactgctcctcagctatcttttcctcttctcttcctgaccggagctcctctctgtcacttcccacacctcggggttctcccaatgtcagttactcccactcctgtatttctgacctctctttccactggatctctgcccatagaacaaaaccatgctaaagcattctgtttaaaatcaaagtaaaaccaaaaccaaacagatgata

SEQ ID NO: 265281 - DNA, 187 bp, Homo sapiens
aaggccgggatggagctgctgactctattatacacactcctcttctggggtcccttgctgtccacattacaggtggttttgggcaacgggcagcactgggaagtgacagggtgcaggagggcagggttggggtactctctccttgccacactgtccctctataatcacagtgcccacagtgtcccca

SEQ ID NO: 265282 - DNA, 2662 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattcctacctctctgtaccttggtttcctgctctgtaaaacaggaatgagaagccctacttgcaaggttgtggtcaccattccaggagtcacatcccgttagagctcctggcacaggtgtatgccgagcactgatggatcgctgtgctttgaacacaaaggtcctgctgggaacctctcctgattctggtggcaactagtacttatatgtctgtgtcacttgcctgcaaaatagcgattctgcaactttccaggaaataacctcagcctgcaaatcaggtctaggtagcatctggatcctgcccacctcttcagcctcatctgcccaccctgtgactgctaggccgccttactctctgcagtctacgtattgtgcacagtccagtgggaatctttaggacacactgagctctctccgcactgctcacagcccatccatggctcctggatcctgaacctcccatcacatcctcttcgtgacatcactctcccacttcagtccactcctccatcttcaccacttaacccactggtccctctggtcttttccaaatcatttgcaacatgccctgttggttcatacctcagtccttgcacactggggaccctcctcctagaacgccctcctcctgggccttcttctgtctctgtctttgaaaatggagttcaaggattggacttctgggttgagctgagggagagagtgaagcagcagctcatgatctccctcctctaaagccaaacccagggaatgagaaacgtttccaaaggggcacaggatcatctggcaaattaaacaacatgatccaaaaaaatttacctacatgcagcacccgaacgaggaaagggacatctcacaacaatcactttatgcagtagccctgataggaagaaatcaaaggactggaggaagcactaaaacttccctaaatctagactcttgcccatttacggcagcatcaaaaaaccgtaaagtacca

SEQ ID NO: 265283 - DNA, 1464 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcagatcttgaatcattttattggatttcctacattccttggactgggtttcgagtttctcctgaatctccgtgatctttgttgccatccagattctgaattctatgtctatcatttcagtcatttcagactcattaagaacattgctggggagatagtgtggtcacttgaaggtaaaatactctggcttttggatgt

SEQ ID NO: 265284 - DNA, 1690 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattccta

SEQ ID NO: 265285 - DNA, 1430 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcagaagacatcatcgtccagttcctctgcatttgaacagctgttcccccacccctcaataccgtttagagcagaagccagcaaatactatctgtcagggacagatagaaactattttcggcttcatgggccacacagtctcattgcagctcctcaaatctgct

SEQ ID NO: 265286 - DNA, 225 bp, Homo sapiens
gaattctttatatattctggacattagttcctcatcagatgtatgacttaatagatattttctctcattctgtgggttcttttcactttcctgatggtatcctttgatgtacaaaagttttgaattttgttaaagtccagtttgttttttccttttgtcactcttgcatttggtgttgtatctaagacccattgactaattcacggtcacagatttatacctatg

SEQ ID NO: 265287 - DNA, 537 bp, Homo sapiens
ctgctgattaccatgaccgtgacatggctttgaaaagcacatctcatcgctgcctggtgactcctttcagaggctcccccagggcaggttgttttgcaaccagacaatgaaatccaaatttactagggacatggatgaagctggagaccatcattctcagcaaactaacacaagaacagaaaaccaaacaccacatgttctcactgatagagggatagtgccaacccacatagacttagaagagagcaagctggagggccagtcttaacgtgtcccacctcccctctgtttgagagtgtgtctcactggcggtactctcaggaaaccagaaagcgccggggggcccactgatgtcatcaattcagggatttcaagacacatttgatatcttacagagctgatagctgccgtgcataggggaaataaatgagaggaatatgtctgcatagtgggggtgcagctagccttgggtagtgattcatttaatattcttttggctgcaagtaacagaatatccaaataaaattggtgctatga

SEQ ID NO: 265288 - DNA, 521 bp, Homo sapiens
ctacacagtgtgcatcaaccagttgtttgaagacctgacacatttactgagtcctctcttcttctcagtaatcactactacatttcttcaactgtacctgaaatgacagtgtatggagcctaggtgacagttgacccttaaaacatgtcttctgacctgcttgtggaataaatgccttccaggttgctgacttgcttaaatgtgctccccattgtgtctccatcccatagacagagacattctctgtggttctgcaaatcacagcacttggtctagatctgcatatgtgacatgccccaccttgagctacagttggtctgagctcagagtcttaaactcatttaaaagcagtgaagtgtcccaactcaccttttttctcatcctgagcattgtttccttctcattcttatttattgtggtcttctcattcatacttcatttaactgataaggaaatgctttatctgtatcaaaacatctcttgtaccccataaatatatacacctactatgtacccacaaa

SEQ ID NO: 265289 - DNA, 287 bp, Homo sapiens
caggagactgtaggatttgtgcagataaaagtcaggcagcagagtcagagggcagccatagcacgtgtaaggcggcggggatgctgacagcaagacgttttctggagaatctgggttttactgcaaatacaaattcactgttctcaggatggcggagggaccagctccttgggaaggtcacccccttggccacctgttgtccctgaggggctgatggagggaggaggccaccttatgaactgcaccaggtccgtggctttggcggtggaggccccatcactgcaact

SEQ ID NO: 265290 - DNA, 492 bp, Homo sapiens
taagatactatgtgtcttctgacccttcctccttccatcacctctgcccttgtcctctctgcaattggcagacatccgtaaagaaccagccagatgtctccttccctgttgaccttttcctgattcctccagccttccatcctgttgctccttctctgcataaatagcttttttttttaaacgtttctctcttgtagcagcaatcactttgtgtccgttatttatgtgcctgtaagcactgaccttggcacaatgcctggcagatagtagggactcaagaatatgttgacttgaataaatgaatgcatggaatgacaggatctcttgagacacaatctagcaaggtgaaatttattaaaggcaaatgtggatcaagaaaaccaattttacaagctcaaagatggaagggatatggtttaacagcaaaatgtgttaaaaattatttaggggttttggttgacagtttagtatgagtcaccaatgtgacccaaa

SEQ ID NO: 265291 - DNA, 229 bp, Homo sapiens
ttcttttctgcaatgcctctttcagtgacacaaagttaaaaccaggtactatgagtgctcacctgacttttggttcttatgaaggtgtttttttctgtgtggatagttgttaacttggtgtccttgtcggaggaacaatcagtggaagcttctatctcaccatcttgccctgcctcctgtggggttggttttataatcccatttcgtagatggaaaaacaaaaagggag

SEQ ID NO: 265292 - DNA, 260 bp, Homo sapiens
agttctgtttgtgtgggtatggttgctgtagtgcggcttaacaaaaacaatgcttcatatcagtgaaagctcttctttggtttaatttgggttgtggttatattgttttttcacatcacgtgagctgattgcaaggggttaacccaaaatgagccacttcacttaaaattattctatatgttagtttgtgaattctgttgttggtatttaaatgtatatcatagtttaatcatatcacataaagttgtgatttcaggaat

SEQ ID NO: 265293 - DNA, 141 bp, Homo sapiens
ttgttttttttttgcaaaacattcacatacatttaatctctttctcctcctctggttacatcttttctctattcccttctttgtctttacttaattattccaacatcttatcttcttctcccttctgtcgtcttctcgcac

SEQ ID NO: 265294 - DNA, 395 bp, Homo sapiens
aaataatagcacccctaatttttaactcgacacatgggtatccaaaataaaaaccagactcatttgtagctaggtgtggccataaatctaaatcctgagcacaatgggttgtgatttctggtcatacccttaaaagtatctggtcataccttaaaagtcatcccttcaccctttttcttgcctctacccctctgcttggaatggcaaagaaacagggcagaaggagccaaggtctctgcatgatcttgtggatcagagccactatacctgccctgggccatcttcacaagacagaaataagcttccatctggttcagcacactgttactttggggctctgttaccttcacctgagattgtatcctaactaataccttcatccctctctttcttta

SEQ ID NO: 265295 - DNA, 464 bp, Homo sapiens
atcttctactataaaatatactggtaagtataatttgatgatcttttgtaaattatagagttgtaaaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagctagcaatgcagtggagtgtctggtggaaaggaggagagtaaaggttgttatttcataactaaaaagttaatacaaagggcctcagaaggaaaagtttaag

SEQ ID NO: 265296 - DNA, 260 bp, Homo sapiens
gcacgagggttaccaagaaatatttctatgatatagccaagtactcttcacttccagcctgttcctagacaatgtgtagattaatggctttcattattataaaacattgctaaaataaatgatagtagtaataaaatctaataactagcttaagttcaaagagatgcttgaaaagtcacatactaataacaccattccaggaccttacagaacatactcattcacaaacacctgcatcaaatcctatactgcttgaatga

SEQ ID NO: 265297 - DNA, 358 bp, Homo sapiens
tgtgaatatgctctataaattacaaagtgctgtgcaaatactgacagttattatactcataaaaagcttatgcactaatgagaaagttaaaagaaaaagacctagttattcttacagggatgtattttgcgtaagtacaaaatgtatttatgggtagaaaaaaatggaaaatataaatcaaaaaattatttttgtattcattagatgtttttctaactatgtaatgtttagtattgacaatgtagcaacattaaaaattcattgtcttcatgctaaaaaaaacacaatagcatcaaagtatgaaataattaggaataacagatcaaaagtgacatgaaatatacttaagctgaaaact

SEQ ID NO: 265298 - DNA, 920 bp, Homo sapiens
gattggcttccttcacttaataatatgcatttaggatttcacatgtctccttgcggcttgttagctcaatttttttagtgctgaataatagtccagttctggaggtgccacactttgtttatcctttcacctcaaaggacatacaggttccttccaagttttagcaattatgatgaaagctgctataaacacttttgtgtggacataagttttcaacgcatttgggtaaatgccaaggaacaggattatttaattatacggtaagagtatggttggtattataagaaacttccaagctatcttccaacgtggccataccactttgcattcctacaggcaatgaataagagttcctgttgcttcccatccttaccagcatttggtggtgttagaatatgtttctagttgttttagtaacaatgtttcttccttcagcaacagctactctcactgctgaagagaaattattttgaggccacaaacctctgaatggcttgataagaaaggaaagtcaaggagaaatgagagtgagacttcctaaaaaatacagtgagtccactttctgtgtcaactgtttatgtgaaaagatatgtgaatatactatcagccattccataagcaggctgtggcatctctgagcaaattagtcatgttagaatgatatctgaaatgctataagggaacattagtaagttgttcttttttcctacttaagtgacttataaattagttgcttacattcactgtaactagtaatttatctgtactaatctgcctaatttaccttattcttctgtataagatgaaaatcttttccaaaaagcatgagtgcatgttcaaagcttcggcattcttcttccgtccatgcagtcattccttctaagaaaaattttaaaataaaatttatgggcccccaaatt

SEQ ID NO: 265299 - DNA, 297 bp, Homo sapiens
gggccaccatgcctggctggaaaggagtcttaatggacaagccaaaagctgtttcaggtggtaataatctctccacttggaagatgtatatccaataaccagccttacagcttagctatgcttttgatcatcaatgtatcaatacaatgtcattgtaattctggacaggaaattggattcagccacttttcaaatgccagggtagggcacttcccaggttttaacttacagaaggaccctgggtgtcgagttgataccattcctttttttttttttttttttttttaagatgtagtc

SEQ ID NO: 265300 - DNA, 281 bp, Homo sapiens
ggggcagaaaaagatcaatgaccaagagaacgtaacacaggattaactgtagagttagagaggagtcagacgacacagtgcctttgaggccatgttaaagatttttgccttatcctaagagcaataaaaaggttgtgagcagggatgagaatgtatttgggcttgcaaaaagactggtgtgctatatgaattgaagggcaagagtagaagcacgaatactgcttaaaaagctcctgcaggagacctaagtgagggatggtggcaccgtggattggagttat

SEQ ID NO: 265301 - DNA, 276 bp, Homo sapiens
tctttttgatgtcatttgactgatgtcatttgatcgttttgacagaaggcaagggtagtgataaaaagagggcctatctgggcggcgagcgctctcctgaaacacaaatgttggaaacatccaaacctctctaatgtgctttgtcagagaaagagcagaaccgcattagtgcaaatcttaagaaagcagttgacctggctgggaaatgcactatgtgatactgttaatattagcgaatttttttaaaagaatatgcttaaagggttggaaaaaata

SEQ ID NO: 265302 - DNA, 195 bp, Homo sapiens
ttagatggctggatgtggtggctttatttggaaacattgcttcctgactttatcatgccctgggctttatcagctagttctttatgacctctcctatatcctgaatggtcatgaaaatcaaagatcaagttcacaaagtctataaagtctataaagactataaagaaaatgtggtacatatacaccatggaatac

SEQ ID NO: 265303 - DNA, 425 bp, Homo sapiens
cagtatctgctgaagttgaatagtctccataagaatcaaaagctggaaacaacccaaataatcattaagacgtaaatggataaatgaattgtgatatataaggtactacaaaacaagcaaaaaaaagaataaactgttgcaacatgcagcagcatggatgaatctcacacatgtaatattgagcagaagcagccagatgcacaggagtctaaactatgattccatttaaatgaagccaaaacagtggtgagattaatctattatgatgtcagaatagtggttatctttaggggaactgagggatcctttctgggattctgattcattctgtatcttgatttgggggaggcgactacatggtatattcactttgtgaaaattcttttagctgtacttatcatttgggtacttcatgtatattgagc

SEQ ID NO: 265304 - DNA, 515 bp, Homo sapiens
tggtatggtggtgcatgcctgtggtcccagctatttgggaggctgaggtgggagtattgcttgagccagagaggtcaaggctgcagtgagccaagatcatgccactgcactccagcctgggcagtagagtgagaccctgtctcaaaaaggaaacaacaacaaaagcaaatttttaaaaaattaccctgtttcacaataagtggttttttgaagagtttttatcttggtgtatttgttctcagagaaccaagtacttataatcataagtgttaaagttatttaatgtgtttattgaaatggcctataattatggttttgcacccactaaactaaatggaattattcatattctgctgcacatttaaaatttttctgtttaagaccgggcttggtggtcatagttccagcactttgggagacctgtagttccagcactttgggagactgaggtggacagatcacttaagcccaggaatttgagaccagcctgggcaacatggtgaaaacccatctct

SEQ ID NO: 265305 - DNA, 159 bp, Homo sapiens
agaagaatcagtgaaaatctcatcactggggttatttgcagccagactggtccagatagttgagattttactgtagggagtgattgtttctggaccccttaaggcctgggagaaggaggagtgatgatgatctcattgtctattcccttttgtgatggg

SEQ ID NO: 265306 - DNA, 308 bp, Homo sapiens
atatgttggaaccatatccccctgtacctcagaatatgactgtctttggagatagggcagttgagggcttcaaggggtggttaaattaaaatgaggctgtcagggtgggcctattccaatgtgactagtgtcctttaggaagagcagattaagacatacagagggacacgagggacatgcacacgcagagaaaaggccgcttgaggacacagcgagaagatggctgtcacactgtggagtgtatatttggtttttgtcctcgtttcctggcatataatttctaaaatcctctggatcttcacaattac

SEQ ID NO: 265307 - DNA, 247 bp, Homo sapiens
cctctacggcagccactgagagaggctgctctaaaactcccttcctactctcactaaccaggcaagaagtgtgaattttcccccagattattcagggagaaggcaggagaagcaactgaaggcaaggaagccgttgttctatggcttttaggtgtgctcaagatatactgaaacagtattatgtagctttcactacagctagcatacttaaatgccatcaaatttacacagaaaagatgacgacaaa

SEQ ID NO: 265308 - DNA, 350 bp, Homo sapiens
agcataaacctggcttcatgggcttctgagcagggtggacaaaaggaaatggggagatggagggatctttaagtgggaatttttacggcagtgaaactattctgtatgatactgtcatggtaggtccgtgtcattatccatttggcgaaacccacagaatggatggacaacaccaagagtgaaccttaatgtcaaccatgaactttaggtaataataacgcatcaatactgtgtgtgtatatgtgttatggggtgatatgaaggggcctccttggtactttctgcctgatttttctggaaacctaaaacttctctaaaaaaataaaagtctattcattgaaaaaaaggaa

SEQ ID NO: 265309 - DNA, 470 bp, Homo sapiens
atacctggaattcacaccataattggggtgtctttaggctgaaatggagacaacagaaggtgaggtggcttggactcaggtggcattggtaaaggaaatgaaacgcatgcaaatttcacagacaaaagagtagctttgccacctctcattttggctgggctgctctgaggtgctgcatcttttatagtgtctaggctctcatccttaatgacattttcatattctccatcccccatcccccaccgcctctccagtaaggactttttgacaagctgcacttccctgctttagtaattggtgataagatttgtcctgtagaacatatacatagaggattgttcactctcctccttttatgaaataatttttagaaattgagctgttaaaggttgtgtttgcacatgttttttggaacaagaactttaattaaaggatcaaaaagcccaagctcttgcttttgaataactgaa

SEQ ID NO: 265310 - DNA, 541 bp, Homo sapiens
atccacgagcggtttaccgggggggaaaggtcgcttgctgatagtctataaggccaagctgaagcagaacacttcagagcagttgagacagtggcagtcaagatctttccctatgaggagtatgcctcttggaagacagagaaggacatcttctcagacatcaatctgaagcatgagaacatactccagttcctgacggctgaggagcggaagacggtgttggggatgtgatgttatcgcccatcaccatttattgtatattgatacacattgatcttttatcatatgtattattattaaatatttttgagacctgttcctagattttctaactgggtttatttattgaggtctgattttcgatatgtgtttgtattatgccattttaaccatctggtgtgtagtaatgcatacttcttactttcagtgtattactggatagtttgatccatattttacatatctttgaacttcatagtcatgttcaatacgcctttctccctctaaatggatatatagtgggagtgtcagcctttgggat

SEQ ID NO: 265311 - DNA, 245 bp, Homo sapiens
aaatcgtgttaagtgctcacttcactgcgggtcagaaccccggagtgtttcacccatggaaatagtcagcagtcgccacatgcagggtcctcactcactgctggtacctttgtgtagtagttactttgtattttacaatgtaaattaaaaaaaaaagttgggagaggaagtgaaatctgatttggctaaattttgtaaacaaagatgttaccaataaaaccttttgtcccagtgtataaataata

SEQ ID NO: 265312 - DNA, 441 bp, Homo sapiens
tcagcaggcgtgtccccacgtgggaggatggagattctccttccctaagacagaaattcacgagaggctgaaggggattcaaccccgcatccttcagcagacgtgtccccacgtgggaggatggagactctccttccctttctcttcctaacacagtatccacattcctaggaatcaacgttcccagcttttctctgattaatatctaggttcagtactttccccaaagcatatctgtgtcttctcttcttttctgagttctgtaaatctcctttgcttatttttatctgtaagacttttaatactcaacaagttgcaacttttagtaaaaaattccttaagcctttgaccaatgctgggaatatttttgagaatgtagttaattcaggaaagtcattcaatagtgaaagacttttaaaataaaagttagaatgctacgaa

SEQ ID NO: 265313 - DNA, 324 bp, Homo sapiens
ggagtctatgattcccaaaaggctaagaaatactgcttaggacctttgaatggtagatttgaaagtgacttgggggctcctctgtcccgtggtctgctttcccagagaaaactagtgatctggcccagctcatacagctggtaaatggggaagctcatttggagacaggtcagtctgacacctgcctgatttcattttatgatgaatgggtattaaacttttgtgcagtcttacacgcatttcctttttagtcctttttaattttgaaatgaaaaattttatcctttcataaacggttaaataaatcttaagcacatcctagca

SEQ ID NO: 265314 - DNA, 364 bp, Homo sapiens
agcaccctttatgagtaattggtttcaatgttcgtattcttgatctaaacaataaaaaatcaaaactgcattttctcaatgaatatgtttttctctgttttaagtctcaagaagttatggtagaaatgctttacagaaaatatttttcaagcccggcatggtggctcatgcctgtaatcccagcactttgggagactgaggcaggcagatcacttgaggtcaggagttcaagaccagcctttccaacatggtgagaacttgtctctactaaaaataaaaaaaaaaattagcctggcatggtgatgcacacctgtaatcccagctacttgggaggccgaggcacgagaatcacttgaacccagga

SEQ ID NO: 265315 - DNA, 300 bp, Homo sapiens
ccacaacaacaaacacaacacccagattcaggcatttactctctgtatgcccacctacttgggttttccttcatccttaagaaactcagatgaaaacagagctttgttttaaaaaatacttttatttgtttatttcagattgcttctgaggaggaaaatccttctcccaacggaggccgaggccccttctaggaaggcggtttatttgctattacttgaccattacccgggcttagggcttctttattgcatttggcacttggagcacagtcttcttgcagtattttgatgtgttttgca

SEQ ID NO: 265316 - DNA, 440 bp, Homo sapiens
aaacataaatgacatttacaattgtaacagttagagtttgagaattaccaaagaaaacactctgaaatgccaatttgtcacccgccaaattggcaaaagcccaaacatttcataatactgttgtcgtgtcggtggataaaatcaactgttgtctttgggattgtaactttatagaatctccacgtacataatattgacagtgattatttaaactatgaacccacatattctttgatttacagctcacatttttgaaatgctagatatattgcatactagcatactatgtatggaagaggtaattcatcacaacattgttggtaaaaagcaaagactacaggcatcttaaagttcattgatagggttccaattaaatgcagagcagtatgctattattattcttaaaaagaagaagataccttcatgtgcattaatattga

SEQ ID NO: 265317 - DNA, 402 bp, Homo sapiens
gataaagaacaggatagtcttgtgaaggaagactcagtgctaggaagtgttggaggaaaggagctgaggtctcagtgaccagagaccagggtgctgctctctgagagaagctaaagtgagaggagacctcggcacagggcctcaccaacgaatgtgtttctgttgttgctgtggtggttagggggaactcaagaggacaggccgatttctggggggattgagggaaaaacacatttgatcctttgccttttccagtctctttatatttactggttaaatgtaataagtttattgggaactacttgtatgttcaaagattgtgccttccactttctgggagctcacaggattttttgttcgctgaaacttttgtaaattacttagtcttcttgattctgctta

SEQ ID NO: 265318 - DNA, 1892 bp, Homo sapiens
gcgggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactg

SEQ ID NO: 265319 - DNA, 990 bp, Homo sapiens
atggtgacgaaggcctttgtcttgttggccatctttgcagaagcctctgcaaaatcgtgtgctccaaataaagcagatgtcattcttgtgttttgctatcccaaaaccatcatcaccaaaatccccgagtgtccctatggatgggaagttcatcagctggccctcggagggctgtgttacaatggggtccacgaaggaggttactaccaatttgtgatcccagatttatcacctaaaaacaagtcctattgtggaacccagtctgagtacaagccacctatctatcacttctacagtcacatcgtttccaatgacaccacagtgattgtaaaaaaccagcctgtcaactactccttctcctgcacctaccactccacctacttggtgaaccaggctgcctttgaccagagagtggccactgttcacgtgaagaacgggagcatgggcacatttgagagccaactgtctctcaacttctacactaatgccaagttctccatcaagaaagaagctccctttgtcctggaggcatccgaaatcggttcagatctgtttgcaggagtggaagccaaagggttaagcattaggtttaaagtggtcttgaacagctgttgggccaccccctcggctgacttcatgtatcccttgcagtggcagctgatcaacaagggctgccccacggatgaaaccgtcctcgtgcatgagaatgggagagatcacagggcaaccttccaattcaatgctttccggttccagaacatccccaaactctccaaggtgtggttacactgtgagacgttcatctgcgacagtgagaaactctcctgcccagtgacctgcgataaacggaagcgcctcctgcgagaccagaccgggggagtcctggtcgtggagctctccctgcggagcaggggattttccagtctctatagcttctcagatgttctccaccacctcatcatgatgttggggatttgtgccgtgttatag

SEQ ID NO: 265320 - DNA, 415 bp, Homo sapiens
cagctcacagtggagaagctggagatggccctgagagaagctcactctgaggtctggggatcaaatcaaacctgaggctgggtgtgggtgggtctgagcagggtctggacccctcttcttgtgactgatctcctcccgggagtagggttgatacccggtgattgggccagacaggtagggtggtagcacagaattattctgggagtcaggcagaaccctgcccagggagggtcttccctttcaaatacccccatccctgatccatctgattatgattcagtgggtcaagtatggagtacaggagtctgtggttttacaagtctccctggtagtttgagggggcaaccttgctcactgtggggggagctgaggactcccaaagaagagcagagaccagtattccagtggttccttt

SEQ ID NO: 265321 - DNA, 194 bp, Homo sapiens
aaagctaaatactgtgttagtccttttatgtggcatactggatcagaaaacagagcagcaatttcctgggacctgggagtcagagaagaggttggctacaaaggggcaatatgaagtaatttttgggtattggaagtctaagaatggaaaagagtaaatcttactcttcatcaatttaaaaaattgatttcaaa

SEQ ID NO: 265322 - DNA, 406 bp, Homo sapiens
gttttgacaaatgtataatgtcatgtatccacaattatagtatcatataaaatagtttcattgccctaaaagtcttctgtgcttcttctgttcattattctagctcaacccctgaacccctgcttaccactgatctttttgctgtctcaaaagttttgcttttcctagtgtcatatagttggaattatatagtatgcagcctttcaaattggcttcttttctttagaaacattgatttaagctttctccatatcttattatagcttgatagcttattgttttatctttatatagatagatattccttgaaagggccatatatgcaaaataacctccaaatacagaaggagccaagaaatcaaagaatgaggcaggcatatctagtttattggcagagggtgatttt

SEQ ID NO: 265323 - DNA, 672 bp, Homo sapiens
gcctttgaagtgattctgatatttgttgaaatttaagagccatttgttttacttatcatatactactagcattattatttttgagggtcctgaaataaacagagctacagtgttaggtaaacgtagataatattcaagctttatgccacacttttaggttaattttaaaataaatgtaaaggccttaaaatgacattccccaaatactcaatgttacttgtttccattgaacttcaattaattttcactgtgtaacctcagagcacgtttgaatgtgcgcagtactctctccaggaaaacatcagtgtctgttcataaaggtaatgatcaaatcaattaacaacacagaaatgggtacttttgaatttgtagggcggtagcaggtgtaccaataataacacatcagtattaacttagacacttattggttaatcaactgatagctgtgaaatttatagtgctgacctgattatactcaagtcaaaagaggaatgtgttacataaaggaaaatcaacccatccagctcattcaatgacagcatagtttcattctgtatgtgtgtaaaactcaataatattccattgttgagttccatcaacaaatactcattcaatttcaactttgttccaggcatgtaagtgccagaaatcatgcaggcaataaaacagaca

SEQ ID NO: 265324 - DNA, 501 bp, Homo sapiens
actctggaggctgaggcaagagaattgcttgatcctggggggcagaggttgcagtgagctgagataaaaaagagagagcaagccaccaaatgggagccacacacccttttataatctggtctctgaagtcatccattgtatcctattctgtagaagtaaatcactaagtccagtcccggaagggcaattagactctatctcttgaaggaagaagtatgaatttttgcatggacagtcatgcactgcctaatgacgttttgtcaatgatggaccacatatgtaacggtggtcccattagataataatggaactgaacagttcctgctgcctaatgacactgaggccaccataacatcatggtgcaagacattccttatgtgtttgtggtgatgccggtggaaacaaacctactgtgctgccagttgtacaaatgtctaggccatacaattatgtacagtgcgtaatacttgaacataataacaaatgactatgctactagtt

SEQ ID NO: 265325 - DNA, 1438 bp, Homo sapiens
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtccccgcgcccgctgccgccgggccctgcgccgcttcttcgcccgcgggccgcccgcgctcacccacgcactgctcttctgcccgtgcgcgggccccgcgtgcgccgagcgtcggcgccagaccttcgtgccctcctgcgccttttcggggcccggccccgcgccgccctcctgccttgagcccttaaacttctgcgagcgcagccgggtctgcaggcctcgcctcctggcctttcaggtctcgtgcaccccagcgcccagcgcccccgacggctgcctgctggaccagggcgcccgctgcctgcgcgcctacgcgggcctcgtggggtccccgcaggcaccgccgtcacccctaactacgtggacaacgtgagcgcgcgcgtggcgccctggtgcgactgcggagccagcgggaaccggcgtgaggactgcgaagccttccgggggctctttaccaggaaccgctgcttggatggtgccattcaggcctttgccagcgggtggcccccagtcctgctggaccagctgaacccccagggagacccggagcacagcctcctgcaggtgtcctccacaggcagggccctggagagacgctccctgctctccatacttcctgtcctggctctcccggccctgctctgattaggacagcgacctcggatagcacagccagctactccaccctgcctgcgtgggccgcctctgtggcctactggccccttgagaagggactggcttaccccccaagccggccctggtgctttcactccgctgccctttgtaggtttggacaccctgtgtgccgtcccctggggcaagggatgtaggctggggcctgactgtaaagcccccgtctccctgtcaggaggcatcttggttgtaagtccctttattcacagaccttgagaccactggggtctcccacaaggtggggtcaggagagggtcacttttgtagctgagacctctctggagacccagatcccctagagcaggtcagagaccatccagaatcccagaattctaggaaattgtatcagcctcccaagcatataaccccctaaggaatccatcggacaagaccccgtctaacactgcatcctcccaactgggcattacccaccattgtagccacctgtgcaccatgaccatgctggcagagtctttcctgttccccatatgctgcttgaggggccccaccctgtgccctgcctggcattggccctgtggccatcttccccctggtttcctgcagctgta

SEQ ID NO: 265326 - DNA, 1517 bp, Homo sapiens
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtccccgcgcccgctgccgccgggccctgcgccgcttcttcgcccgcgggccgcccgcgctcacccacgcactgctcttctgcccgtgcgcgggccccgcgtgcgccgagcgtcggcgccagaccttcgtgccctcctgcgccttttcggggcccggccccgcgccgccctcctgccttgagcccttaaacttctgcgagcgcagccgggtctgcaggtgcgcgcgggcggcggcggggccgtggcgagggtggggacggggcctctctccggctcaccgccctcccgccgcgcaggcctcgcctcctggcctttcaggtctcgtgcaccccagcgcccagcgcccccgacggctgcctgctggaccagggcgcccgctgcctgcgcgcctacgcgggcctcgtggggtccccgcaggcaccgccgtcacccctaactacgtggacaacgtgagcgcgcgcgtggcgccctggtgcgactgcggagccagcgggaaccggcgtgaggactgcgaagccttccgggggctctttaccaggaaccgctgcttggatggtgccattcaggcctttgccagcgggtggcccccagtcctgctggaccagctgaacccccagggagacccggagcacagcctcctgcaggtgtcctccacaggcagggccctggagagacgctccctgctctccatacttcctgtcctggctctcccggccctgctctgattaggacagcgacctcggatagcacagccagctactccaccctgcctgcgtgggccgcctctgtggcctactggccccttgagaagggactggcttaccccccaagccggccctggtgctttcactccgctgccctttgtaggtttggacaccctgtgtgccgtcccctggggcaagggatgtaggctggggcctgactgtaaagcccccgtctccctgtcaggaggcatcttggttgtaagtccctttattcacagaccttgagaccactggggtctcccacaaggtggggtcaggagagggtcacttttgtagctgagacctctctggagacccagatcccctagagcaggtcagagaccatccagaatcccagaattctaggaaattgtatcagcctcccaagcatataaccccctaaggaatccatcggacaagaccccgtctaacactgcatcctcccaactgggcattacccaccattgtagccacctgtgcaccatgaccatgctggcagagtctttcctgttccccatatgctgcttgaggggccccaccctgtgccctgcctggcattggccctgtggccatcttccccctggtttcctgcagctgta

SEQ ID NO: 265327 - DNA, 518 bp, Homo sapiens
ttttggtactgtaattaatatattaaaaaagaaacattctgatttttttctggtctggctttttttctgtataattaaatgtaaacctaacaaggtttaattaaatttagtttacagctgttgcggcaaaaatgcaaaaagcaaattagagggaagaaaatatggtgtatgctttgtagacagatgggactgaatctctgttatccaaaatgttcttttattattggtacattttatcagtaaatcaaggatagataccaaatattaatgtacacatgagccaattacttctaactagatttttctcttagtattttttatctgtttcattattagtttatcagctccaaattagcatatccaaatgagttacccagcaatagataaattgcttttgattttgtgtcataattaatatttttatctagtcatttatctatcattttagaaactagccaagtctatgtgagtcataaaagaaaaatgaaaattatttactattagttaaattacagtgg

SEQ ID NO: 265328 - DNA, 450 bp, Homo sapiens
tgtcttttcccacaggttagagactatccataggataaatttctagcaaattgctgagtccaggatatgcatgtttgcaattttggaagatcttaaaaacttgcctcctataggtgttgtaccagtatatacttctgccagtaatagatgggtgggctgctgatgcctcaaaatggccacagataattttaagcttgagcaaagaaccaggcctcccaacacaatggaaagaaaggaggcaccgtgtgaagggaagatggcatacgtggcacagacctccacctctgctcaccaccacagaaggccactcctgcatgggcaggtgacggcagcgtcaggaagggaaatcagatttacttaggttgttagtcattattaattgcaatagtcttgtgccttcatttaaaaaaagacgaccaaaaaataaaaacaaaaacatgaacactaaat

SEQ ID NO: 265329 - DNA, 537 bp, Homo sapiens
tgtcttttcccacaggttagagactatccataggataaatttctagcaaattgctgagtccaggatatgcatgtttgcaattttggaagatcttaaaaacttgcctcctataggtgttgtaccagtatatacttctgccagtaatagatgggtgggctgctgatgcctcaaaatttccacaggctatacaggaagcatggctgaggaggcctcaggaaacttaacaatcatggcagaaggtgaaggggaagcaggcacatctacacatggccagagcaggaggaagagagagaaggaagaggtgctacacccttttaagcaaccagatcttgtgagatctcactatcgtgagaatagcaaggaggaaatctgcccccatgattcagtcacctcctgccagacccctcctccaacattagggattacaattcgacacgagattgccggtgggacacaaatccaaaccatatcatattctttatacatttgggaaattaacttttttctgtaatatgatttacaaatatttttctcaga

SEQ ID NO: 265330 - DNA, 716 bp, Homo sapiens
cacgaggcttcaggacatgtttctttgatcacctcttttccagaccatcatcaaaagtttcattcaggtgcaaggtgcctgctgctgtgacaagctggaaaatccattgcatttccagggtcacctgtttgtcattagcttcatcaatgagacagccagcatcaaggtcaaggtcttcacatccaggcttctctcaagccccaccaatgagctaaggtattcaacttttccaagtcactcacaggtttgctcttgcactcaaagaaactctgagaatcccctactgcattttaacatttgtccagtattcctagtccttggcacatgctcctcctggaacccaacctgtaaggtaacccaacctgtaaagtggatgcgaaggtttaaagggtgtcccctggaattcatgtgttggaaatgtgagccccggtgacgttgctgggaggtggggcttttatgagctgatgaagtcattaagagggattcatgcctgtctcccaggcctgggttatatctcttgggagggagcgagttctcactctcactcacggcactggatgagttaccaagagtggctgttataaagccaggcgcccctcacgctgtgccccttctgcatgcctctgcttccctccccagaagctgtcaccatcctcttggacttcccggcctccaaaacctcaagctaaataaatatctttcctttctaaattacc

SEQ ID NO: 265331 - DNA, 398 bp, Homo sapiens
cactttttttttttttttttaaagaaggagtctcgctctgtcgcccaggctggagtgcagtggcgcaatctcggctcactgcaagctctgcctcctgggttcacgccattctcctgcctcacactcccgagtggctgggactacaggcgcccgccaccacgcccaactaattttttctatttttagtagagacggggtttcaccgtgatagccaggatggtctcgatgtcctgacctcgtgatccacccgcctcggcctcccaaagtgctaggattacaggcgtgagccaccgctcccagccccaagttacatttctaatggcattcatttacttaacacaaacacctgagtgcctaccaggagacagaaactactctaagcattgagggcatggtaa

SEQ ID NO: 265332 - DNA, 294 bp, Homo sapiens
attcaattctcataattctcctgacaacattctctccaagcctcagttctctccttcaaaatcattatgattattcccatttttcagataaggagcctgagtcccagagagcagaaatgacttcataacttcacatggccactaggaggcagagcccagacttgaacctaagctcagttccaagtgccacctaacacttgaactctgatcctggggaaccaagacacaatagggaggccataaaaactgtggaatgaatcagtgaacaaataaatcctatttctaaagagagag

SEQ ID NO: 265333 - DNA, 419 bp, Homo sapiens
agtctaatttaaccttaattacctgcataaaggccctatctccaaacatagccacattggaagttaggagttcaacacatgaatttgtgggggacacaaacattgaatccatagctgtagttatcctcaaatgtttcttagtccattacttgtataacaggatgttcaagtgggacttctctttattgtctcactgtctgctaaagccctaacactaaccacaataggtgccaactaccttcaaatttagagaaaggggcaagaccaataatttgttctgcttgcgttggtctatcactcatctccagatgatataagaaaagactaagtatccgttaaggaggagcaacaaatggtaagctttcttcaggaagaaagttgtagcctgggcaacaaagcgagaccccatctctccaaaa

SEQ ID NO: 265334 - DNA, 177 bp, Homo sapiens
ctggtatcacaccactgcaccccagactgggcgacagagtgagactgtctcaaaaaaaaagaagtgaccaattgcccaaaagtagaaacactgcatgctacttctcaaggtgtcaataaaggcgccacagaaatcttagaaagctccaaggtatccaactccctcattgttcaaaca

SEQ ID NO: 265335 - DNA, 502 bp, Homo sapiens
gttccggtgactgcaggggttttcccggtgctcggtgtttcctccccgtcggcctttaaacgcgaatgtgaccctaccaccaaagtggagtgcagtccagaatcaccaaacctgggcttccaggtgtctggaaacacaatgttaacatttgttttgctccaaaacaaagtatgaccgtgtcggacgttttagtccagccccaaattttgcctctgagcaagattcccaggacctcattggagcagtttacagccagtcttatctcactattaacttccattttctgctgtagtacttaaagtgacagaagttactcttcctagaagtaacttttccagacgattcaaactgctgttatacagagatttaagtatttgtgtgcatgtgtgaaaacagagatatgtaatgtatatatttcattttatttccactgttctgcttctctttttaaaaataaagcggtctcctccactttgggtaaatctttcagcacatttgatca

SEQ ID NO: 265336 - DNA, 144 bp, Homo sapiens
gagaatggagtcagccccctcacatttatatgtagttcggttgtctttaaaagcaagcaaccatttgtttttctcattagccgtcttcatgatccatatgtagtttgctttgcatcttgacctaaaaaagtatcaaaattctta

SEQ ID NO: 265337 - DNA, 481 bp, Homo sapiens
tgtgtgagcacgtgcatgctgctgtttgaacccaggcatgaaatacttgaaggtgattgcgatgccctgaccaggctcttctcttccaatactctgccatgttccctgtttgttttaacctgtaggaagaaggaggagttgcggatgatagtgccatttctaatctgctttgggtaagcctgactctaacacaggtgtcctctcgatggtggccagaattacacttcgcgtgggtaatcctgatcctgggtggttccttcgtgcaccctccctggtgcttttcttatctccagaccagacacagcctttgtccggagtggagagctgagcccgtgcccttaaactattttttaatcatgtaatgaagatactttaaagaagatgatattttctgttaaatgttaaaactgtcaatgaaagtcatggttcctctctctgtaactgacaatcttctataaattaactcatttaattactgcac

SEQ ID NO: 265338 - DNA, 435 bp, Homo sapiens
tccactcctcctgcccttggacaccagactccaggttcttctgcctttcgactctgggacttgtaccagtggtttccagggggttctggggccttcagccacagactgaaggctgcactcttggcttccctacttttgaggctgttggacttggactgagacactgttggcttctttcttccccatcttgcagatggcctatcgtgggactttgccttgtgatcatgggagccaactatccctaatgaactcccttttatatatacagagatactattggtcctgtccctctggagaaccctagtatactgtgcacactttataacttctctctagagtagtcacgtcagttttctggctgttgtctccactgcagtctttccccactctaatccaccttgaatagaacccaaagagtgaccttcagagagctca

SEQ ID NO: 265339 - DNA, 823 bp, Homo sapiens
tagtctatttattgtttatctcctttttataaaataaattacttttaaacacccctgctaatatttcaggatattattcacttacgtagaggtagttgtgttcccattttgcttctgttccatttcctggtgttattcatgtgtgaagagaatctttttggctgggttggcctgcctcaaagctgctccaaacttataattcaccaaaagtgacatcatcccagccaccaccaaagaattatgattggagtcgaggcattgcccatggaacacataactctgcagtggtttcccctacaaaatgtcagccactcttacgatggaatgtgcccttgcctgctgtgggcaccgctcaaatctaacccatcatttttcttttcattttgattcacttttcctttcagagattcaaacaaaaagaaaaatgggaactgaaaaaatttggggtttttgaggggtgagggagagaccttatggtagaaaataaagtgttttttttgatatctgaaattttatatgctcaatttaaatgttttattgcgtttgttttttccaacctgtggaaaccccttaaattcttactgaatgcatagatcttttatttgcatgaatgtcctgtatgccggaagactaagtgggagcactgaatgctttgaagttctgtgcctgtgagacttgggtattttaatacattgttaccctattgcatcaaatcacgcctagggatgcattcaataaagactgccccctccccgcttagctgcgctgggactcccttctggagggccagagtttctactttgtttctactttgactcctaaa

SEQ ID NO: 265340 - DNA, 744 bp, Homo sapiens
cataattgattttttaaagtaaatggaaaacactgggctagaaatcccctaagtcagctgaaattagcaggagtgcctgacattaagttcctgagacttttttatttattaaaaaaaatgctctctgttaatacatattttacttttgcataattttaatacgtaaaactgtgaacatgaatataaacaaattatgtaacacagggtttcctacaactctattgttggactataaaggacaagaaaataacaatttttatccctctaaaatcagctcttgtatcagggtcctcataggaacctcacatggtttaagaatttgatagactgctttcaaaggggtgagagaatttagaggagccagtaaaggatgttgaggcactgaagagcctagaaaccacaggaagcccttgccactcctaagcctaaagggcaagaggagaaaatttctctaccagagcccagtgagacatggaacaacctaaaaagtgctataatcctgggggaatgcagcatgttccagaaaatatgacccagagcagaaaaggaggggagaagaaaaacctaagtctctttctttcagtcctctgatcactcttgatcttcactggctgaatttaaccagaagctagtaggaggatgctcaggtgtgtaatccacagggatcagcttcctggggcaaagaacagaacagaacaaaggatctttcttgtaacagtggtggtggtgggagtagaggctgga

SEQ ID NO: 265341 - DNA, 1234 bp, Homo sapiens
ttatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgtaaaaaaaaataaaaatgtatagtcatttgcaagtataatgtgataactgctgtgtttatttcctttgtctggcataaaaggtgagaaaaaggtcatacatgttgttaagggtagcagtttaggaagtgttttctaataatttgttttgttatattgcaaataattgatatgccacttatttctgcaagaaaaataggcttgaagtggttgggatattaatcattttgatagtatctacttaaagcattgatctgttttgacttgtggctctgaaccctgggctaggctgagggataatagtagtggagtagggcaaagatataatatcctatccagtgttttgtgaccacttatttgaagattagtgtgggacatgaggaccttgctacttttttgccaagatgctgcaagtctcccaaatcacttcaactgtgtttttaaaacatgtttaagcaacagaattatttttttgaaattagtctatacgttagacagtctatacatgacaaacatgaagatctaatatcaagatttgggagacgggatcttggaactccacctgtttgaccactaggaccactgaggcacctccaataagctctgtagagtgcctccagcataattcaaaatccactgacctaatccattatggctttacttaacattggagtgatccgtaaagaatatagtattggagtctgaactggaacggtaactcgtaagactcaagaaagaccgtttaaggaaaattggcataatacaaactgttcctgttgacttaagaataacagtaggttcacctatctgaggaaattaagtagttgatagtttaatgctaggcatcttttatgataataaagtaagatgtc

SEQ ID NO: 265342 - DNA, 396 bp, Homo sapiens
gcttatcccctactccactcaaataggcctgttccacattgtgaacacctgttactatttgattgcctctgcacctttgtgctatctatctaatcaccttctttctcttacttatctggataagatgaatttaatctgcaagtacagctgaaaaaatttttgtgacatgaccttgactcaaggagaaagcagtctttccttttttgttaatgattcatttcattaacaccattaatgttgtttttgtaaaggatttttattatttctgacatgtctgtgaaccctacaagactgtgatcatctctgtgaagggattcctgtcttttctttgtacctgtattaattttccatgtcttctttaacaaattatcacacacttggtggcttaaaaaaaaa

SEQ ID NO: 265343 - DNA, 460 bp, Homo sapiens
agctcactgcaacctccgcctcccgggtttaagcgattctcctgcctcatccaatgctgggattacaggcctgagccaccgcacccggctagcctgtgtctgttctttaaaattgttttgttttccttactctcagattcttcttgctgcttattgtgccttgttgctgcctgttgtgcaatttcttccctcttgtattttactgaacttcatctgaagaagccttagtagccagataaacaagcttgtttgggctaaaaaatcaattgctgtgtgagagtttgttggattctcttctgagtaaagggtatgtgttttattgtacggactttgtatcacctattttggcttttcatccaggccttttttttttttctttctttttagcttcctggttctagatacaactgatactctgatacaacctgggtaaatgtggtcttgagtagtaaattatctg

SEQ ID NO: 265344 - DNA, 433 bp, Homo sapiens
acgttgtcaggctcctgtatgaatcctccagagtgttgttcccaccaaggcactgctttagggctacaaagtggacttattccagatagttgtaatttaacttttctatgtgaaaaaagaaatggattcacattaccgtgaggtagcaatgaatacctctaagaggtcagcgatcgtggcctacggtggggatcaggcattactgctgttatcattattgttaccaattcaaagtatgtagtaaaaaaataaaacagacctcaacagtgtcattggatcaggatcagaaaagccaaccatttttgtcagtgccaggaacatttaagaaataagtatttctactctatgccttccattttccagtcatcttactttataaatgagcgttcatttattgcagttgctaggggagtaaagcattcacccacaaatt

SEQ ID NO: 265345 - DNA, 351 bp, Homo sapiens
atatatagggttattttcttcagatagattcccagaaattgaattactgggttaaaggttagagcatttttaaggcttttgctaaatgttgccagattgttttccaaaaagactataccggttcaccctcatcagcaatggtgaaaggctgaaatggtgactgtccccttttccaaactgcgtattattttattaagtactgtactaatttagataagctgattattgttatagcattaataactcttaatggcattagtaaagaatttttgaaaatccatatgagatcatatttttgcattgtttaggtgatatatagtatattaaataaaagtataccaaaaatatcaa

SEQ ID NO: 265346 - DNA, 172 bp, Homo sapiens
aaagagaaagctccatgccagcagtgtcagtcagctccaggggacgtagctcagagtaaaggaggaaatgtggttttcactgacacccatgttcaagtgttggttaatgacagcaaaacagccacacagtttacattccttttacaaagggtttcacacatgagaccctggc

SEQ ID NO: 265347 - DNA, 453 bp, Homo sapiens
agcactttgggaggccgaggcgggtggatcatgagttcaggagttcaagaccagcccagccaacgtggtgaaaccccgtgtctaataaaaataaaaattagccgggtgtggtggtgggcacctggaatcccagctacttgagaggttgaggcagtagagttgcttgaacccgggaggcggaggttgcagtgagctgagatcggaccactgcactccaggctgggcaacaaaaatgtgaaaattcatctcaaaaaaaagaatgcaattgagatattcttgttaacttgggcaaaggttttatatccctttaaaaactaaaataaaaaggttttagctagtttttctgctagctaaagactagaataaccctgtagaaaattatataccatattaaaatgatgtatcttgtgttctgcagaaatcttactaagctataaacatttgacaacagag

SEQ ID NO: 265348 - DNA, 544 bp, Homo sapiens
tgtaaaaccactagttgagctagagtaagcaaatgatctttgtggattctaggaattaattgactaaatatcccatgtcctcctgcttacactcctaccaacatagtattggaggttgtctgatgctcaccccactatttttatggatttttatcttgaggcacaatgggttggggttagttctcctagactcttgttgttctgatttcctatttcttctgaattatttttttaaaattcttttttaatttttgtgggtacatagtaggtggcatgtaatgtataaataattacatcagagtaaattgggcatccatcacctccccagtatttttcttttgtgttacaaacaacccaattatagatttagttatttttaaatgtacaattaaattatttttgactgtggtcaccctgttgtcctagcaaatactaggtcttattcattctttctattttttggtatccattaatcatccctactcctctgcctccctgctacctttcccagcctctgataaccacccttctaccctctatcttc

SEQ ID NO: 265349 - DNA, 422 bp, Homo sapiens
ctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctg

SEQ ID NO: 265350 - DNA, 385 bp, Homo sapiens
gaccgtcacctgatggtcatccaactctcctgggtgtgtgtgtgtgtgtgtgtgtgtgtgtgtaagtcctcttctgtgtgtgtgtgtgtaagtcctcttctgtgtgtgtgtatgtgtgtgtaagccctcttctgtgtgtatgtgtgtgtaagccctcttctgtgtgtttaagctctcttctgtgtgtgtgtatgtgtgtaagccctcttctgtgtatgtgtgtgtaagccctcgtgtttgtgtgtgtgtgtgtaagccctcttctgtcctgctcatacctgactagctacctactgtaacactaggactgcaaccattttgttctgcggtgaagtttccagaattaagccagggatgtaaaaaacaatgttagttaagaaaaaga

SEQ ID NO: 265351 - DNA, 214 bp, Homo sapiens
ctgggcgacagagtgagactctgtctaaaaaaaaaaaaaaaaaattgtggcacggtaacttgttagcttgcaagtagcagaaaatctcagacttttcagtttctgacttcacaagaaggaattaagaaaagtcaggaaaaatgtgaataaactgaggtatctgtcccatccgaaagtgaccgggtgactctcttagtttaagaggatttatgga

SEQ ID NO: 265352 - DNA, 377 bp, Homo sapiens
atatagtgattgtatgtgtatgtgtttcaaacaacagacctgcgaaatatgtgacacaaaaagtgttagaactgaaatgagaaatagactctacaattatagctggacactttaacacccttctatcaatacctgctagaacaagtagacaaaaaaatctgcagcaggagcctgggtaacatagcaagaccccatctctacaacaacaacaaaattagctggggaagatggtgtgcacctgcagtcctggctacttggaaggctgaagcaggaggatcacttgagcccaagaggatgaggttgcagtgagctatgattatgccactgctctccagcctgtgtgacagagtgagaacctgtctctacaaaaaaaaaaa

SEQ ID NO: 265353 - DNA, 481 bp, Homo sapiens
aaatgtgataccctaccttgttttaacctgattgactctcacttagctgagagagccagactccattttggtttcttcatttgcagccccttatccccttcccttaaggacataactggtgcaagctgactccaagcacattcaggaacgcacttactgttaagatactggggcaagctgtaccagcagcccctgggaacgcactcggttgatggtacccaaagcccctgcatttatctctttgtgatactttaagcccttgcacctggaactgtttatttttctgtaactgtttctgtaaccatttatcttttaactttttgcttgttctgcttctgtaaaattgcttcagctaggctccgcctccactttttagaccaaggtataaaaaaaaacatctagccccttcttcggggctgagagaattttttagttctagctgtctctcggtcgccggcaataaaggactcctgaattagtc

SEQ ID NO: 265354 - DNA, 622 bp, Homo sapiens
agtaattggagaaccttgaaccccagctaatttgacattttcaccttttctaactttttttcagagtgtgttgacattcaggtcaattttgagctgcttttaagagtacccagtgcctagtatagtataggcatttaatgcctttcaaataaatgactgaattgttcactatatgggcaaatgacaatttgtaaataatatccctaaatgcagagtacctaaatgcaatacaaatagtagtcacattatgtttattgttttaaactagaaggttttggcgtagtctgaaatgatattatagaaggagcaagaactttggaatctgaaaagatctagaattgaatctttaccttaacatttactgctggttactacaccttccttaggcattccacacaacttctctgatcttcagtgtcttcacctgtaaatttgggattatattatctaccttacaacatctctgggaggaccatctaaattaatatatgcaaggtaccctgcacaatgcttaattcataaaatgtgctcaaagttcatgcatttttagaatttgtgtatacaactttgtagccaattaacagagcccccaagtaacagattgtgtgttttctgattaacc

SEQ ID NO: 265355 - DNA, 529 bp, Homo sapiens
  misc_feature (320)..(320): n is a, c, g, or t
  misc_feature (485)..(485): n is a, c, g, or t
cttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggngccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggngcttaggttgtagagacatttcccaaatattcaaggtgttctgt

SEQ ID NO: 265356 - DNA, 746 bp, Homo sapiens
gttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagccattattatggagttgtagacctggtgtggggagtatggggatcaacctcagaagcctccagagagagattggtggactctaggagtgtcgatctcagactgaccatcgctggggccacatccaagcagcagccctttgtccagagccatttcctccactggcctcagtttctgtagggcccagatggtgctgaagtcagatgccaaggggaaagtgactttacccacgagagagatttttaaatattcccccaactgctccgatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgctgggatttaacatcctcggatgtattaacgtccagggctgacttggcaggtggttg

SEQ ID NO: 265357 - DNA, 815 bp, Homo sapiens
gttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagccattattatggagttgtagacctggtgtggggagtatggggatcaacctcagaagcctccagagagagattggtggactctaggagtgtcgatctcagactgaccatcgctggggccacatccaagcagcagccctttgtccagagccatttcctccactggcctcagtttctgtagggcccagatggtgctgaagtcagatgccaaggggaaagtgactttacccacgagagagatttttaaatattcccccaactgctccgatgggaccgtctagttacaggaaaacaagctcaaggctcccactgattctacattacgtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatt

SEQ ID NO: 265358 - DNA, 922 bp, Homo sapiens
gttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagccattattatggagttgtagacctggtgtggggagtatggggatcaacctcagaagcctccagagagagattggtggactctaggagtgtcgatctcagactgaccatcgctggggccacatccaagcagcagccctttgtccagagccatttcctccactggcctcagtttctgtagggcccagatggtgctgaagtcagatgccaaggggaaagtgactttacccacgagagagatttttaaatattcccccaactgctccgatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatt

SEQ ID NO: 265359 - DNA, 528 bp, Homo sapiens
agttttctctaagtgcttatctatagaagagagtattgagactcttaattttatggtttaaagacagggctgattgattgattgatttcactctgttgtccaggctggagtgcagtggtgcaatcatagctccaagtaacctcaaactcattacaaagcattaggattataggcatgagccactgtgccctggtctgggatctttatcacaatttttcttctactttgaatgcactcaccctccttatctatctgatgagttactttttatccttcattatccaaattgaaagtcacattttctagaaagccctctctgggattccttgtcatagaattaaacattttgttttctgcagttctatactactttgtctaaacctctatgaagtaactttagttaatttattcagccacaaacatttatttgttaatgttattatattgctttcatgtttgtctttgctactagggtataaacttttggacagcagggactatattctcttcatctttgaatctctatta

SEQ ID NO: 265360 - DNA, 120 bp, Homo sapiens
agtaccattttatcctgtaggctcagataatctaaacagattaaataagaggtcacttttatattctagtaatatcaatcttttggttgtaggaacctgaagggaccccccccccccacc

SEQ ID NO: 265361 - DNA, 604 bp, Homo sapiens
taaacatttgctagggaaggaacagataaaatcagccacatgtttatggtttttcaacaagtgtcacaaaaataatagagcaaagaagctgaaaagaaactgaagagatacttttttctaactctttgcattgttgtactgtttaacaacattattaaatctttttttttttttttttgaaacagggtctcactttttcgcccaggctggaatgcagtggcgtgatctcagctcactgtaacctccgcctcctgggttcaagctattttcttgcctcagcctcccaagtagctgggactataggcacatggcaccatgcccagctaatttttgtatttttagtagaaacggggtttcaccatgttggccgaggcgggcagatcacctgaggtcgggagttcgagaccagcctgaccaacatggaaaaaccctgtctctactacaaatacaaaattagccgggcatggttgcgcatgcctgtaatcccagccactcgggaagcctaagctggacttctttaacttcgaaagttgaagattctgatagatttcatctcactgtcttccatcttaatgaacttatttctttccatttacgctctccc

SEQ ID NO: 265362 - DNA, 456 bp, Homo sapiens
cagaagagttgagaggggcatcaataccactcttcttataaggctgttgacatctcagctaaatattcagagtgtctcaactgcttctctgaattctggcaggacccacctgcaaatgagaagatttccacagacaggctggtggatgagcccaggcaagtcagttatacgttcaaactgaaagagactataaaaacttgatttttaaatgactaaattcaacaatgataatcacccgtattcttatttcctaggtcaaggacagaggggaaaatggggaaaggacaaaagagggggccactgcttccattcatggtcaataaatgtatcacaagatacagacctgaactaagaattcttcttcttcttcttcttcgtttttttttttttctttcgagatggagtctcgctgcaatgcccaggctggagtgcaagaccccgtctcaaaacaaaaaa

SEQ ID NO: 265363 - DNA, 358 bp, Homo sapiens
tgatgaattcccatggacagctagcaaattatctgatgtgggaagcaggttcaggatttctgaacgatggatgatcctgattgacatttcatgtgacagttctcaatctcttcgtgattgggaaagtggcacttataaccaccatctactggttggagtgcagtgatgcaatcatggctcacttcagcctctacctcctgggatcaagcaatcctcccacctcagcctctggagtcaccgggactacagatacaaacttttgagacccacccttcgtaagaaaaaaaatgcagaagaaagacaaattggatttcatttcaagaaaattgaaaataaaattcttcatactggtaaatta

SEQ ID NO: 265364 - DNA, 294 bp, Homo sapiens
caagatatgtcttcttgttgttgtctcataaataaagaaacgggagagtctaacaagataactgacttgtacagagtcacacagctagttggagtgcagtgatgcaatcatggctcacttcagcctctacctcctgggatcaagcaatcctcccacctcagcctctggagtcaccgggactacagatacaaacttttgagacccacccttcgtaagaaaaaaaatgcagaagaaagacaaattggatttcatttcaagaaaattgaaaataaaattcttcatactggtaaatta

SEQ ID NO: 265365 - DNA, 399 bp, Homo sapiens
accctcatgtgtttatacttgcatcctgagtgcctaaacaaggatggcaacagattttatcttaggagctaattccagtcttatacttgggtgccatgttttaaaaaattgtggggttccatctagatttggcaaggaagtatacaagttgattaatgactgattctctgtcatgggcacagaaggtggtagtgtgacaatgctatcatgtatttatcaaccctggtggtaataggagataataatgttaagtgattcaccagatgggtaagtgaatttaaaaacaacacaaagtctcttcatctgaagaagcaggtataatattcattaatctgaggcaaggtgagaccatctcattacttattcctattgcattactatgttactgcaaaaaaaaaa

SEQ ID NO: 265366 - DNA, 461 bp, Homo sapiens
ttcccaagagcaaggctggagggcggaaggctggctgggctgatgggaccaacgcttgtcagaaatgaacaggctcatgcgacagtgaagacagagcagagggaaacagcttttggcttcatgctttgacaaagtgccctgagaccgtttgtccatgtgtgtgcgtatttctgttcggtaaatcctggaaggccagtgcagtgggagaatccatatgttttcagcctctaaaacatgccaggtagttatagttgacagtggggtatgtgagaaactatatggtactggcctcattcttcatgctgccactctggcctttgaccttggagtggggaattccttaaattcacacatccctgagcccctttgtgggtgacccaggccctggcatacactgtacaattaacaaatgtcagctgaatgagtagaatgaataaacaaaaaagagtcattgtgtaaca

SEQ ID NO: 265367 - DNA, 354 bp, Homo sapiens
tatggggtccatccattcagctatgtgttgctgatcccggcttgtttcagcgtccccttcaaccaccaaaaaggagatctggaacagcagggccatgaacaaggaggagaagaaggactgcacctccatctgccgactgggttccagcaggagctcatggatggccctggtggccttggagggaggaggagagtgaagcattatcgtatcttcgactcataggtcctgtcaccaggaaatctctttccacaacccatcaccatgacagacttgcccagtaaaacccgtgctgctagagcaagtgaagactaagttagtgtgagccagacaaataaagggcaatttctagaatgt

SEQ ID NO: 265368 - DNA, 382 bp, Homo sapiens
gtaatcaagtataaattcctccctctcccattaccttactttgctataaaataagtcaaataggaaacaagcacaatttaaaattcagaagtgggccaggcatggtggctcacgcctataatctcagcactttgggattgtactccccagatgaggcaggcagatcatgaggtcaagagatcaagactatcctggccaaaatggtgaaaccgtctctactaaaaatacaaaaattagccaggtgtggtggcacacgcctgtagtcccaactactcgggaggctgagacaggagaatcgcctgaacttgggaagcggaggttgcagtgagccgagatcgtgccactgcactacagcctggtgacagagcaagattctgtttca

SEQ ID NO: 265369 - DNA, 218 bp, Homo sapiens
atgtttgttgattttaaaataaataattctgaaaatataattgaggtggaaatgcgtttgccttaaatttttattacatacttatgcacggctttaggtaagtataaaaatgtcattaaataatatgtgcagatagaattatataaaaaaccgaaggaaaaaattaggttatgggcatcctaaaagtaacacaatttactaaaatatataataataaa

SEQ ID NO: 265370 - DNA, 497 bp, Homo sapiens
taaaagtagaagaaaataaaagtgaatatttattaacttttatatgacagcaaaataatgaagaaagttgcataaaactttcttcatcttcgtgaaaaaatcaattgatttgacttcctaaaattaacttgggaaaacagcttggcagtttcttataaagttgagcatgctacatgacgcagcattcacactcctgggtttatatattttagagaaatgaaaacatgggttcacatagtaatctgtacatgaatgttcatagcagttttatttgtaataggaaaatactggaaacaacccacatatcctatatggagtgaatgggtagacaacctgtggtacatctatacaatggaatgctagttagcaatgaaaaagagtcagacccaggagtggtgatgtgcacctgtagtctcagctacccaggaggctgaggcaggaggattgctcagcccaagaaaccagcctgggcaacatagtgagaccctgtctctgaa

SEQ ID NO: 265371 - DNA, 521 bp, Homo sapiens
aagaatcccctgaaaacatgctggtatttgaaaatcctgcattcccaggaagggtgtgcacatggaggatcctgacggtacctgactgtgtgcagatgcagcagcccaaactctgactctgaccctacttctgtatcttaagcccggtagatcccttgcaactatatgattcctctgttatcagttggtgataatggtgccagagagggcagaattgtttcagaattcagagagaggatggcatgttaaaactggaagaaatattctagatcaagacccttattcagtagatgaggacaacgaaagtagagaaacagtgtgcccgacccaggtctggcttactgaaattcctggttgatgtctctgtgctccctattcctgcccacctctcccacttcccgagaatgtttagtcatgacaaccaaaagagattcgttaatcaggggacccactttggtgaaaggagatgattctgtatcattaactgattaaataaaacaaattccaatacaacatttact

SEQ ID NO: 265372 - DNA, 287 bp, Homo sapiens
gagctgtaaagagaaataggtggtccaaaagacagagtccaataggtgaaggaaattcataaatggtttacattgtcatcaactagagaggtagattacaggcaatatttgaaacctactgggaagcactgtcatattccaagagaccatccctttgtggccacagacatctgggttcaaagcctgtctgacttcaatagctagagaaacttttatgggtctcagtttcctaatacataaaatggtgatataatagcctaccctggagagctgttttgaagatggaa

SEQ ID NO: 265373 - DNA, 797 bp, Homo sapiens
gtacttccgctctaaggacgcaaatttcggcaggacatgccccacccccgcgttccgaccgctgaagctccagtgagggacgcaggcattctactcttcgattggtcgctgggggaagaatgacgggcgcctttttaaatgctttatttcaataaaactttattagtggaagagcgccagctattaactacagacgtctctggtgggtccctggtcccggcccattctgtgtctgttctaagccgctggagagctggagatcaggactgcactgggtacctgaggcaagagaaaagctgtaacggaaggagtgaagaagagggaaaaaaacgggatgaggaaacaaggggcagagaggaagcaaacaaaaatcaataatagaagtttagcagcagagatcacctaggtggttcaaccactcacttttttgaagagcaggagaaaagaagcgagaaaaataaaagagagaataaagctaacatgtattgagtgcttactattggtcagacatcttttaaaattttattccgttgaatcctcacaaatattcccctgtgacttcaggacaccctctaccatgattactacatatgtattaatacttgtagaatgatgctttcagtacatggactcttaatttcttggggaggaaaaaaccctatgtggttctcattttacagaaaaggaaattgaggctcataaaaatccaaggatttatctggagcttttcaaactcaaaaccatctttctacttcaatatgatactttaataaaaacaaaaacaactaacatttcta

SEQ ID NO: 265374 - DNA, 337 bp, Homo sapiens
gtgggaaagacactgggtatgtgtgtggggggaggacactgggtatgtgtgtggggggaggacactgggtatgtgtgtggggggaggacactgggtatgggtgtgtggggaggacactgggtatgcgtgtgtggggaggacactgggtatgtgtgtgtggggaggacactggatatgtgtgtgtggggaggacactgggtatgtgtgtatgcggaggacactgggtatgggtgtgtggggaggcgctgggtatgtgtgtgtggggaggcgctgtgtatgtgtgtgtggggaggacactgggtgtgtgtggggaggcgctgggtatgtgtgtgtggag

SEQ ID NO: 265375 - DNA, 367 bp, Homo sapiens
ttttttgagatggagtctcactctgtcacccaggctcgagtgcagtggcgccatctcggctcactgcaagctccgcctcccgggttcacgccattctcctgcctcagcctcccgagtagctgggaccacaggcacctgccaccacacggggctaattttttgtatttttagtggagacgaggcttcactgtgttagccaggatggtctcaatctcctgaccttgtgatctgcctgcctcagcctcccaaagtgctgggattacaggcgtgagccaccacgcctggccgggctactcttttacttcttcatacttgtgtgtcagctccacaatgaaccatttgcatatatttctgcttgaggcaagta

SEQ ID NO: 265376 - DNA, 147 bp, Homo sapiens
ggcagcacagcctgatccccacctaaagcatttgttcttaccaagcattggtggggtgccagtttggtttttattgtgttatgtgatttaacttccactgagaacattaattcattcatcaaacatttatcgagcccttcctaaatg

SEQ ID NO: 265377 - DNA, 508 bp, Homo sapiens
gaaagttcagagaggtcacacacagtggtctttattacagcattacacacacttcaggtaattatctagttttatttatccaattcctgaaccttccagaaatggatggataagttactattcaggataaaaacagccgtggaaatgaaaggaagagccatcttctaaagttacaatgtaactctaatgcctataatgcatataacatctaatgcatataaccatatttatcaaaataacattcatatacattattttcccctccaattgaaaccaaatgcagaaattcccccaaatgtagtcttttaaaaagtaaatacatatttgttttctttttaaagttaaaagaacaaaggaaataataatagtatttaggagagcttaaaaaagatatctatttccctttgtcttaactcagatccaccaggtggcagtaagtttttacccacaaacagttctggagactttgacatttgtaaaaataataaaattatatcatgttaaaaaa

SEQ ID NO: 265378 - DNA, 326 bp, Homo sapiens
aaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcctcaggctctgtgggtgccgctagctggggctgccagtcctcaccccacacctaaggtgagccacagccgccagagcctccacaggagaccccacgcagcagcccagcccctacccaggaggccccagagctcagggcgcctgggtggattctgaacagccccgagtca

SEQ ID NO: 265379 - DNA, 223 bp, Homo sapiens
ttcattgtatctccatgggtagagaaaagtagttaatatgttgtgcggtgtttctgaaagcgaggtccacggatgacctaacatttgtattgccacgggactgtgaaaatcgactctagacgtactaaataggagtctttaaggggggagcagggcccaggagtctctattttaatggttttttttcttcttcttcttttagtcctagctactagactaccag

SEQ ID NO: 265380 - DNA, 426 bp, Homo sapiens
cacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcaccttt

SEQ ID NO: 265381 - DNA, 416 bp, Homo sapiens
tctggcagtagcaaggagtccattctgagttatcagttctactcctagatatgtgccctagggaaacttttgcacatgtaccaggctatccatggcaagattgttaaaaacagcaaaaagttagaaatcacctaaatgtccctttacaggaaaatggataaatcattataatccatataatgcaataccatgcagcaattaaaatgaataaaatatagctacacttaccaacctagataattctgaaagcacattgcagaagtaagtgtgcagtgtgatatcatttatataaagtttaaaaggaggacaaagaagagtatacattgttctgtacattccagatgtatacaaagaagagtgagtatacatctggatatgtttagaggtaaacattaaacaaatgcatgagaaagatg

SEQ ID NO: 265382 - DNA, 447 bp, Homo sapiens
cagggatttttacaatgcttttccatacaatgtctggaatctatagataacataaccagttaggccagggtcgatcttttaactaccaggcccagggcacagcgctgggctgtctgcctgtggatttcatttctgccttttagtttttacttcttctttctttgggggcagaaattgggcataagacaatatgaggggtggtctcttcccttaaaatggtgacatataactttgcccttttctattttttctatttactattaactctttttttttctattaactcttttctatttacttcctttggtctcattttcatttaagcctttttggtccttgaattgttctagaagtcatttactttttttttccataggagagtgagtttaattcagtttctaatagtagtaggttatcttgctggtaagttatgggcatttgtttatt

SEQ ID NO: 265383 - DNA, 434 bp, Homo sapiens
gaaatttataaaaacaaaaaatttatacccaaattttaaaacctggagcaagttagccttagtattttggagaattttcttctcgattgaattatacatagaatacatggcttgcttccccccgcccacaaccccatttaatgttgttttatgagaatttccacatgccagcaaaaatagtttatttctaaataataggtcatgctagaactatggtctacgttagaaaaactttgtgctaattgttgaaaattacatatttcagatgacataactgattgcatttcaatactatgggcattgagaaatatactggaggttttatattaggaatggatgggtgatgtcaaatcatatgaaaaagacctatgctttctacgtaagatcttaaatgtgtgtactgaagcaaattaaatattacttgcaatgtacgt

SEQ ID NO: 265384 - DNA, 489 bp, Homo sapiens
cggtgcagtgaggagcgagggtgattgtccacttacaacaaagtttgcaactccctggatagtcctttctacaccttaagagaaccccttcccctcttcaaaattggtgttccaaggcaagaagttattttcaccagggaagcctgtgaacagaaagagctcctgagactacacctgcttttaatttggtgtcagtaggaaagatggagatgaaaacctcatcaagaccagcacggatttgggaatcaccaatagagtcaacccctcactctaagatgaggaaactaaggccccctaaggtgaactgtgaactgaattgatgaaagctgggatcaaagcccagatctctgggctccttgtctggtatttatcttccctgctttcttcataattaaattcagtgtaatgacgcagacgtagagcaagatcctggagtgtcttcttaatcatcaaatattgtcctctataaagttataatgtttagtgaaa

SEQ ID NO: 265385 - DNA, 465 bp, Homo sapiens
accgcaccgcacactcagcggaggcgcgcgccccgcggcgaccggaggatgtcccctaaactgctccaattcacaaacaaaggtgttccaaggcaagaagttattttcaccagggaagcctgtgaacagaaagagctcctgagactacacctgcttttaatttggtgtcagtaggaaagatggagatgaaaacctcatcaagaccagcacggatttgggaatcaccaatagagtcaacccctcactctaagatgaggaaactaaggccccctaaggtgaactgtgaactgaattgatgaaagctgggatcaaagcccagatctctgggctccttgtctggtatttatcttccctgctttcttcataattaaattcagtgtaatgacgcagacgtagagcaagatcctggagtgtcttcttaatcatcaaatattgtcctctataaagttataatgtttagtgaaa

SEQ ID NO: 265386 - DNA, 322 bp, Homo sapiens
gtatacacattttacaaaagtcattttttaatgttaagaaaaaattatcaattgtttccaagatctttataataagctactaaattggtatactaatatagctttgtcctaaaacttggaagccataccaaaaatccttgattcagattcctttctaaaatagacaggaaacaggtacaaaaaaaaatctttctttttctgatgatatgtgcattatcttgtttataaaagccacggacatcgcaactgcttaacacaggcaaggatccacttactgataccttcctgaagctgaacacatggaaatgtcgtcgttgccact

SEQ ID NO: 265387 - DNA, 483 bp, Homo sapiens
actcatctcgccatcattttgcgcctcctgcatcccccgtctcactgttcttcactctgcttgttatcctgccctggactgcccttccctttgcctagaatgctcttcctccagatacctgctttgctcaccctctcgcttccttcagggttttactcaccacatctctgaagcttctctgactactctgtccatccttgacactttctattgcccttccctgcttttatttcctcctgggcacttttcacaaatttgcgacttactttactcatttggttatcatctccttctctcttcaaaacattagtaagcttcatgagagcagggattttgttttgtccactgctatctccccagtgcctagactattgcctggatgatagtagaagctcagggcatatttgttgaatgaatgaatgaatgtgcttcatgtagactgcagtttagctaatacagctagcaaaggaagcagcagtgaga

SEQ ID NO: 265388 - DNA, 164 bp, Homo sapiens
gtagagatggggtttcaccatgttagccaggatggttttgatctcctgacctagtgatccgcccgcctcggcctcccaaagtgctgggattacaggcatgagccaccgcgcccagccacaccctcttttctttatctgtccatctgtccagccacactctccca

SEQ ID NO: 265389 - DNA, 559 bp, Homo sapiens
tgaagagtactgttacagaagtaacagctgatgtcactagtgctgtaatgagaaatcctgtcactagagaatttgatgttggtcagcacattgccagtggtggcagtgggctagcttggaagatttttaatggcacaaaaaagtcaacaaagcagtggctgtttttgtctttgataaaaaatgattgacaaatatcaaaaatttgaaaaggatcaaataattgattctctaaaatgaggagtccaacacttaactcgacttcaacaccctcgacttcttactgtccagcattctttagaagaatccagggattgcttggtgttgtgtacagaaccagttttttgccagtttagccagtgttcttggtaactgggaaaatctccctttccctatatctccagacattaaggattataaactttatgatgtagaaaccaaatgtggtttgcttcaggtttctaaaggattgtcattcttgcatagcagtgtgaaaatggtacatggaaatattactcctgaaaatacaattttgaataaaagtggagcctggaaaataatg

SEQ ID NO: 265390 - DNA, 757 bp, Homo sapiens
agagacagggtcttgctgtcattcaggctggagtgcagtagctggggctacaggtgcaggccaccacacccagctaatttttccattttttgtagagatgggatcttgccatgtcgcccaggttacatttttttaaatcatgagtttctgaaggaaatggggtagggcaggctctggtaggggctggattgttcgagctcctgcttgaattcctgcatacactggggaaaagggggatccccagggccagggatggggaaggtccctggctcattagacaggaaggcaatcttgattctaacccctaatgctgtgtggtgtatggaaagtcactcaacctctctgtttcctaatttgagactctgggcctgctgggtctaatctcacatagcaaaaagcactacaggctgggcatagtggctcatgtctgtcatgccagcactttggaaggctgaagtgggactattgcttgaggccaggagtttgagaccagcctgggcaacagggaaaacctgtttctaccaaaaaaaaaacctgggcatggtggtgcacacctgtagtcccatcccagctcttctgggaactgtgagtgcaccagaggcagctccttgggcactgtctgggagggaacctgaaccacaggtgaagaccgactcccctgtcccctgccgtgtctggggacctgacactgggtttgtgtctgtgctctagccgtgccctgtaggggaaagggcaacatctcgatctgaacagatat

SEQ ID NO: 265391 - DNA, 383 bp, Homo sapiens
tgcaattttttttaagagtcagtctcactacattagcccaggctaaagtgcagtggctattcacaggcatgatcccattactgatcagcacgagagttttgacctgctctgtttttgattttgggccagttccccacgccacaggcaacctggggttcacccaggaggtcaccatatccttgccgaacttagtgcagacatccacactacacccagagctcttgaagtcaagtgatcctcctgcctcagcctcctgagtagctgggactacaggtacacactactgtgcccagccttttagctcattttaaattataaaagtacagttttcatcatttttctgcacgtatgctttctgataagccgttttttttttttttttt

SEQ ID NO: 265392 - DNA, 428 bp, Homo sapiens
ctgaactggctgggaggctgctggaatggcccttggtccacagctctccacaggcaagaggtcaactgctgcttgaaagaggtagacaaaagttaggttgatggcgaaatgtctctgggttacccagtcttctggagcagcaagctgagctttaatgggctaagcattagggtgttacagaaaatttcaaatgcagccatctcccttggggcagatctacctagttcatgacagtatgtgcggctggccagggctttacacctctgcatcttaagttgttaatacataccaataatgtaatatggctttttaaaggagaggagagtgctgggttgggaagggaggtggttggtagagtcacaacttctcaatgagtgaatttacagctgatgggaaaaggagtgtaactgtgaaaaacgatggctgtg

SEQ ID NO: 265393 - DNA, 390 bp, Homo sapiens
ttcggcacgagtaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggatttgaaa

SEQ ID NO: 265394 - DNA, 777 bp, Homo sapiens
aggtttcagaagggctgtctgtggctgagatctttgaggcagaactgttgagacggaagggattggcatgaagctttggaagactggacgtgtggttgtttcccaaatatggtacgtatgccactggtagtacagtgactgattttaggaggtcccaggtatagtattaaatcatcttcagtcatatcacaaaaaaattagttccttttcagtgtccttggagtccttgacatcattcacagagaatgcctgcgttttgggctatgtgatctctgccagctcacagaagcttacctctttttgtgccatgtaggtagatggggattcatagcctttggcaggcaacaatatctggctagaaactaatagtattggtgttttttttcctcattgaattatttcttatggttttaaacattttttaatgatttttaatgatatatttaggggagtatcagtttccattcacatagtatatagggtttccttttatgtgaattaatttttttaatacaaatacattaagtaaccataagttaaagtaaaatacaggtagcgtatcgcttatcccaaatgcttgggactgaagtgttttagattttggattttttttttcagatttttggaatatttgcattatacttactggttgagcatcctatatccaaaaatttgaaatctgaaatgctccaatgagcattttgttttagtgagtgccatatcagctctcaaaaactttccaattttggcatattttggagtttggatttttaaatt

SEQ ID NO: 265395 - DNA, 558 bp, Homo sapiens
caacatgcctcttgggaggtagattcaatgtgaggctaatctccgaggtataggaaatacaggaaggaggagcaacaggtcgggtagtggtggaagcaggtttggaaaatgtgattagttttgtaagcgtttttgagtttgaagtgccactggggaaggcttttggaaatttatttccagagttcaagactgagctatcattgcagtttgctcagctatttactgagctatctactgtcaatttggatagtatctacagtttgcattgtagatactggatacttggattggctggtgcaccctgtttgtgagactcactggagtttgaagagatgaccactggaaaatatccctaagcagtagctgcaattccacccccaccttggagagccaaaaccctcttcattttcactctcctgtccttggtcttaggctacttaaagcagcctttagacatagggaaaaattgaaagcctctcttttaagaaaaacattaggtacttctggaatagagagttcaagaaattaggagaaaaatgaacttttgaagctttttct

SEQ ID NO: 265396 - DNA, 486 bp, Homo sapiens
tacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttatttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaattttta

SEQ ID NO: 265397 - DNA, 538 bp, Homo sapiens
cacgaggccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagca

SEQ ID NO: 265398 - DNA, 390 bp, Homo sapiens
ctatttatccaagtcttcttttacttctcttggtagcatgttaaaagtttctttatatagatctttcacatttcttgtacatttaacctgttactgtatctttttcaatttaaaagtaaatgcattatttttcctacatgctttctaaatggctattgtttgtatacaggataacaatcctgtatttgtataacaatcctgtatacaaacaattttgcttccagttaccttactaaattttcttattagtagtaatgattttcttccccagttgattttcttgggatttactcatatacaaacatttcctttgcaaataatgaacattctctttcttcctttcaaatttctcatatctttctgttgtctaactgtatcagttagtacctc

SEQ ID NO: 265399 - DNA, 622 bp, Homo sapiens
tatcaagccaaaccgctcattgaatatgaacatagaatagatactttcagatacacaagatcagataaacaaaacatttgtctcctagtcaccctatgcaaaccattggaggatgaactccagaaaagtaagagtaaccaagaaagggaaagagatggaatatagggaatgggagatcccacaaaggagagattgaaaggcatcctcaaaacagtagcgaagggaagcctggggtggcagctgggcctgaagcactgaggatgactagaacagactggatccaggccagagggctctaggacagattgtgttaagatgaaatggcttgaatacctaatgtgtctgaacatatatttaggaggtttagacagttggcagagagtttgcgattaaattattgataagtacatagagacaaagtagaacaacagaaaagacagttgttaattccagggaaaacaatgttgtacaagaaagaataagtaatcctagtatattacatggcttacctagatacagcaattaaacagtcaaaataatgtcaacactggatgtagatctaaccgccatgacaggggtaagggggctcacagcagtgaaagagccaaatcctcatttaccg

SEQ ID NO: 265400 - DNA, 696 bp, Homo sapiens
gtctaaactgctggcagctactgctggttgtcgaagcgcactccttactccaaagtccaactttaaaggattgtatgttttagcagctaccattcttaaaagctttctaagcaccccatggtgctaagtgccctatgtgatagcctcctttaatcctcccaataatactatgtggaaggttctattattaagccaggacttgaaccgtgtccactgagtctggagtccaagatcttaactacaaactctcagttacctttacagaatgaaagtctttgctaggcaagaaaaaagtcggccaatcattactggcaacaggcccctgttgaagcaataaattttccgaggccaacacttggcaaatgtcattcagactgtacttggttatcctgaagttctgagggactctctggaaagatgatcttaaaattaggataattctttaattgtggcatactgagcacaacatcaaaatgaagcctccaaagtccaagcacacactatacctaacaggaaaaatacttctagcaaatcagaggaaactgctgttggctatctttaggccagaaatgagaggggctgcacagcagggcaaatggatgtctgggtgcaggttctggtctatcacatgctagtgtggaaccctgggcaaatggcttatcttccctagccctcagtttcctcttctgtaaaagg

SEQ ID NO: 265401 - DNA, 414 bp, Homo sapiens
aggataatttgacttctttccaatttggatgccctttattcatttctcttgtctgattgctctaggtaggaattccgagcccttttttcaactaggtccttgctttatttcaactaggtcccctgatatctcagtctgatcaaaaagtcctcatcacccatccttgatatctgatcaccctggcctgtcttcagcaacaatgctgtcaggtcagtttagcaagaatccccctacccttgagatcttctctgagttatttattttccatccaataaccgttcatccttctcattggctgtaagtccccaggtgtctttactgtattcagagttgagcttgacaaagctcccctattgtgattgtgttggcacccattacaatactcctgaataaagcctgtcttactgttttaaa

SEQ ID NO: 265402 - DNA, 483 bp, Homo sapiens
cctggtgccggatgatgaggtgatattagtgggcggggacacccaagagaggggctcatgcagcgctactacaaactcgtgtgggaggatttccatatttcagtatttttaccatctcagtcacctccagccagggaagccacgctccgctggggcgggagagttgtggaacaggctcaggcagcccctgctgtgcccctcccacaggatcctgagcacagtgaaatggtccttgttttagggaattgagttttggagtgtgtgttccctacctagctatatatatcccaaaaatatcctggtgttcaggccaccgtgcccaatggaagagggcaagcccttcatatgtgtatggctggaaaaggactctcatcgatttcccttttgaatttggagccctcaaaatcatctttggagaaaggcatagtcctgtctcccacgcacacatccttaactttggcaaataaacctcctgaaatgtta

SEQ ID NO: 265403 - DNA, 431 bp, Homo sapiens
tcacatcttccagcccaggagacagggatggcctggagaggtcatgggaccctgtggggccatctcagtcacctccagccagggaagccacgctccgctggggcgggagagttgtggaacaggctcaggcagcccctgctgtgcccctcccacaggatcctgagcacagtgaaatggtccttgttttagggaattgagttttggagtgtgtgttccctacctagctatatatatcccaaaaatatcctggtgttcaggccaccgtgcccaatggaagagggcaagcccttcatatgtgtatggctggaaaaggactctcatcgatttcccttttgaatttggagccctcaaaatcatctttggagaaaggcatagtcctgtctcccacgcacacatccttaactttggcaaataaacctcctgaaatgtta

SEQ ID NO: 265404 - DNA, 513 bp, Homo sapiens
  misc_feature (20)..(20): n is a, c, g, or t
agagaggaatttttcactgnagaaagctcaagcatgaaggctgaatggtggaagaagtaggctctgatggacattacagtttatccctccagatccactttccttccccaggccacgctccatcctgctctgtgcttcaccaagttggcctgtatgggctatgctggtggcttctttgcactctgtcctttggttgggcctagccaatgagaggcactggtaagggatgagagggtggagaagaatgaggttgcattatatattctctaagctcattctctggtggcctgccacgaattggccacctcactccaccaaaagtagttctttctgtcaggtagccctttctatgaaactactctctttgagttcaagcaacttcttcctcctcttacactttagatcaaggggtggtaacagctcctagcccttgctagcctgagattgctgtacaaatttactggttttcttgatgtctgcctacacattattaaactcttctcattatccaaa

SEQ ID NO: 265405 - DNA, 457 bp, Homo sapiens
gaaactaaaagtttgggatctgaaggagagaaaaaaaggctcttaatttgtgactgaaaaacttctgtttaacttttatctttgtgaaactgtaccttgctgtctagctatctgataaggttctgtactgtatagaaatatattattcaggaaggagaactgaaagtgcgacaacataaatgtaactcaagaaagcattgtgggccaggcgcggtggcccatgcctctaatcctagcactttgggaggctgaggcaggcagatcacctgaggtcaggagttcaagaccagtctggccaacatggcaaaaccccatctctactaaaaatacaaaaattatccaggtggagtggtgtgcacctataatcctagctactcaggaggctgaagcacgagaatctcttgaacctgggagatggaggttgcagtgagccaaggctgtaccactgcactctagc

SEQ ID NO: 265406 - DNA, 504 bp, Homo sapiens
tttttctttttttcaaagcccgtgtaaagaaatcatagtaagaatgtgtaatagcctcaaagaagataaagatggtttttattaacccaaacatctgctaatctttaaagtatttctgacatactgctaaactgagaaaggagcccccactggggaaaaggaatcaccatgaaaataatttgctgtaaaatagctatctgaggactgagatccagcattctcagcaagccgtggtttactacactgttgcaggcctcaaaaggcttcttagatgaccatttgataaacttcatcttggtgaatgtacccatctctgtattcgactggggtggaggtgtgctgttaggaaactaaaatctgcatctatgctttcgttaaagaagaaattacgctctgaaagacttgaagaatattgccacaaacgaagtcttcttagtttaattactgcttatgtaaaagtggcctttttttttttttttgagatggagtcttgctctgtcgccc

SEQ ID NO: 265407 - DNA, 495 bp, Homo sapiens
gatgatgctatttaaacagaagtttacgaaaggaatagaaaaagaaactctattatttgcactgtaacctgagtttatactgtaaatagaataaattcacattggctttctagatttggaaaaatctatatttatacctatgcaatacaatatctcttccaatggtaacatttctaagggaagagatattgcctctttcactgtatgctttaataaatgtaacagcccatattgaggaactctttacatgtgtaaggaagaactattcaacagtgagctatttgcatttaagatagggagttacgggtgagtaatgaactcattcgaaagattctaagatcttacttagatgacatttgaaggcaggtataaggccatttggtagggatatcctagttccagtttatcggtctttgtgcattcgcgttgagttgagatgactatttgcagataaacacacttcatctgcaaatagatttttaaatcactattaaa

SEQ ID NO: 265408 - DNA, 483 bp, Homo sapiens
gtttttttgagacagtctcactctgttgcccaggctggagtgtggtggcacaatctcagctcactgcaacctccgcctcctgggttcaagcaattctcctgcctcagcctcctgagtagctgggattacagacatgcgccatcatgcccagctaagttttgtatttttaatagagatggggtttcaccaggttggctaggctggtctcaaactcccaacttcaagtgatccacctgcctcggctacccaaagtgctgggatccaactgttttttatctctttcatgaatcttattatgtatgttagaatttctcactgcatcagatctgtctttccgtacttctatatcttgttgtattctgactatttcttttgatctaaccctcagtttattaattttctcttcacctcatctaatctgttattaaactcaaccattgcattcttaagttcaattgttgtattttcaattgagtttttaga

SEQ ID NO: 265409 - DNA, 598 bp, Homo sapiens
caagtcaattccttaagcagcagtgactcctgtatatcctttgcagtggctttattcagctcatagcttgcctcagcatgtaaagaagcagatcagttttaccatttctattctcggcacatagagccaaatgcccagaaataatgtgatttataccaagtgactctcctcaattgctctgtctccaggacactcacttccctcccatgatgcagttattggggttgcctgcccctgacccaggagaacctgccttcgtgataaagcaacactgcccccatctaagctactctctggacacctctatccagcctgctcacctgctcgtaaaccatgcaaattcttcttaacatcaaccattgccctggaagagtctagaagtagggatatacactgcaacacaatattcctagatgttgttcaatatgagatttttactccaatttctagctgtcccctgctccattcatgcattaaatatttattgaggagctgctttgagccataattttttgtagttgctggggatgctgcactgacagtaaccatcattgttcctgccctcgtggatcttacatttgaagagagaaaaccaatt

SEQ ID NO: 265410 - DNA, 468 bp, Homo sapiens
ggctgtataacatgcattatgttttcaaacttccggcaagctgaacagtacatcttcagtacatcatttcccctccttattatatccctcgtacttgaaacattcttaaagacctgtttttatggatctcagacatagtatatcattctttataccactcaagggtatatataagtacctcagagagagaagaatgaaatagtatctcccatgcttttgtatctccttatttgatgtgttttcagatcccaaaatgtacggagctagtggattagataagttctcagataaaaggttctctgccagaaacaactgatgatcctgatgtgattctaaacatacacacttttggtttgatccatactgaatggtttgattaaactgatggtaggctgggcatggtggctcatacctgtaatcccagcactttgggaggccgaggcgggcggatcatgaggtcaggagatc

SEQ ID NO: 265411 - DNA, 701 bp, Homo sapiens
gtaggttctcgattcgagaactagctaggttctcgatcgttatatgggagttgcatctatcatttcaaattccaaaggtagcttttacatttcacaatcggcaagagctggtatttccatttaatggaatatataccatattttattataatagctccttatccctcactatccagaattctagttccagcactgccaccaacaggctaggtaaccttgggtcaagtcacttaacttctgggtcttccagcttaacaattcagcgttaggctgggcgccgtggctcacgcctgcaatcccagcactttgggaggccgaggcgggcggaccacccgaggtcaggagttcgagaccagcccaaccaacatggagaaaccccgcctctaccaaaaatacgaaattagccaggcgtggtggcgggtgcctatagtcccagctactcgggaggctgaggcaggagaattccttgaatacaggagggggaggttgcagggagccgagattgtgccactgcactccagcctgggtgacaaagagcaaaactgcatctcaaaaaaaaaaaagaacaaacaattcagcactcatatggggaaaagcataaaaactgtggcctaaaaagatggctccagggacatccagaattgctctttgggccccaaatgcaaaatggttttggggttagaccagggctgatgtggtgg

SEQ ID NO: 265412 - DNA, 1608 bp, Homo sapiens
tgctttatattagttaatttctatatttatttaaaataaaaaactttaagagggactttgctcctgttgcccaggatggagtgcaacagcaccatctctgctcactgcaacctctgcctcctgggttcaagtgattctcctgcctcagcctcctgagtagctgggattacagccacagaagcaaggtgacaaaggcaacatcatcgtttggaaagcgtcgcaataagacgcacacgtgccactgctgtggctctaaggcctaccaccttcagaagttgacctgtggcaaatgtggctaccccgccaagcgcaagagaaagtataacggcagtgccaaggctaaaagacaaaataccaccgggactggtcgaatgaggcacctaaaaattgtagaccgcagattcaggcacagattccgtgaaggaacaccacctaaacccaagagggcagctgctgcagcatccagttcatcttaagaatttcaacgatgagtaatgcaatagatgttccggtttaaaaaaaaaaattttatgaatactaaagtttgaactttacataatttatacatgtcaccatataatactcttttggcttttttcagtccttaaaaagaatgtaaaaaccattttagcctgcaggctgtacaaggacagatgacacgctggtgttggttcaaaggccaggctatagtagtttgctaatccctgctgtagaggaagcatcggaactgataacattacggtgttaaatgataattcttagaatttttaagaacaatttaacagaaaagtacatatatcaacaatcaattattaatatagtgatgattttgcttatttgcaactgcttatgacatacgtccccacactatgttgtcaaagatataaaagcataccagttttactaaacttcattagagtgcctaatattaatttgcttgtcttcgttatatgggagttgcatctatcatttcaaattccaaaggtagcttttacatttcacaatcggcaagagctggtatttccatttaatggaatatataccatattttattataatagctccttatccctcactatccagaattctagttccagcactgccaccaacaggctaggtaaccttgggtcaagtcacttaacttctgggtcttccagcttaacaattcagcgttaggctgggcgccgtggctcacgcctgcaatcccagcactttgggaggccgaggcgggcggaccacccgaggtcaggagttcgagaccagcccaaccaacatggagaaaccccgcctctaccaaaaatacgaaattagccaggcgtggtggcgggtgcctatagtcccagctactcgggaggctgaggcaggagaattccttgaatacaggagggggaggttgcagggagccgagattgtgccactgcactccagcctgggtgacaaagagcaaaactgcatctcaaaaaaaaaaaagaacaaacaattcagcactcatatggggaaaagcataaaaactgtggcctaaaaagatggctccagggacatccagaattgctctttgggccccaaatgcaaaatggttttggggttagaccagggctgatgtggtgg

SEQ ID NO: 265413 - DNA, 428 bp, Homo sapiens
gtggggaggggagatctgattaattattggagacttccttcaccattaggaaaagaaatgaagaattcttagccagacaggggctaaggacaaagtatgtgtttgtgtggtagttaggggtggggggagaggtacattagcaaagccactattacaatttagatccttaaggattctgtgacaaatcatgatctataatacggcatatttccaattttgaggcgatactaatctccctatttcatctgaagtagcatcttccattagaaaggcagagaggtctttaggcagaactatatagctactcgactagaggtcccaatttatctaagaagagactagtaaatttttaaccaggctattatttcttctaatcagtgccttattttcaacacctttagaaaatggtcacaaagaaagtcttctta

SEQ ID NO: 265414 - DNA, 621 bp, Homo sapiens
agatgaaggaagacactgaagatttctccccaggaactaggaagctgagcaatcaatttccattgggagataagcacctactcttaaaggcctcacccagtctccccacacctgagggcagagatgagcacagggcgggtgggtggaggaaagtccgccagtgccagcctagacaggcaggtactccccatgccagggctggtgtaggaagcacagagatcttccaaccaagtgccctggggtatttcacaaagggaagttaatttgtgtgcaagaaacagcaatttttcacttgctgacagtgaccaggtcctcactcttcctgacaggcctgtgcgagcacttcccagcctacgtgccactgccccgtgcaacagatgagaaacccaagcttggagaagcgacatgagctgctcaggccatggagccattacatggtggggccagacttacacccaagcttgtctggtgattgtgtgaaggcaggggtttcttccatagttttcctgtttgtgcttctcattcttgccaacatacgttttcccacatgaaatcaagaacagagtataggctgggtgcagtggctcatgcctgtaatcccagcactttaggaggccaaag

SEQ ID NO: 265415 - DNA, 418 bp, Homo sapiens
gcattgattcctaggaaaccccactgaaacatctcccttgaaagaagtatccatttacccctgtgccttcagcctgaatttgctctcccctaatttgagtaaaataactcttagagtttgtgatttccctaaaaagttaagcataaaatttgacctagcaattctactcctaactatattccaaaaagaatttaaaatagatgctcatatctttgtaaacaaatgttcgtaatggaactattcacaatagccaaaatgtagaaataacccaaatgtccactaatggataaatggataaacaatttatggtatgtgcatgcggtgaaatattattcagccataaaaaggaatgaaggggtcaggcacggtggctcatgcctgtaatcccagcgttttgggaggccaaagctggtggatc

SEQ ID NO: 265416 - DNA, 534 bp, Homo sapiens
catcataagccctgtgaaccctgtttcctctaaataatttcaggcaaattggtgagtctgttttatttgcagagatttgtagatcccataatgcatttatataattcttgattcatctttgattataagtttttttttgtgattataaattcgatagaggaaaaatcattatggtccatttaaacttgaagaaatgtatctctccatgagcattaaattgccatatccattttaggaaagttttaatttaacccagatctgtacagaatataaatttataatgtaacaatttaatggttttcagctattggtagactgacttattctttctgctatatttagagtaacatacaggattaattttaaagagattggaatatggtgcttcatagtgatttctggattctcctgaaacatgccttaagtaaataatgttccagagttttagggtactttactatctccctggtttgcaagaagtaggcattggagaaaatctagcacaggccatgtgctttcctctcattaaaaaaa

SEQ ID NO: 265417 - DNA, 580 bp, Homo sapiens
gggttcattaaaccttcttttctttataaattacccagtctcaggtatgtctttatcagcagaagcatgaaaatggactgaaactttgccatttcttttcctcacctcaaacctttctccttctactattaagtgtatgaattgaatgattgtattattactgagagaggatttgatgaagtaaatatggagaaagaataaggtttgccaaaggtttcccaggtaggcaagacaaaacacatgaacacattggaatgaggagtagagtgcctaaagatgaggcttataaattccatagatagattttatattttctacataggtactagcatttgggttgggtgatattatctcatagcaaccaaaggtggtgtgatatcccaaaggtgaaggttctgcaacccaaacccctttgtcagagccactgtgaaagaatccatttatcaaagtacaggatcattgggtgggcatggtggttcctgcctgtaatcccagaactttgggaggctgaggtgggtggatcacttgaggtcaggagtttgagaccagcctggccaacatggtgaaacttgtctctact

SEQ ID NO: 265418 - DNA, 360 bp, Homo sapiens
cacacatattgatcacattatttatggtagaaacattgggaataaaccaaatgttcaactggaaataattccaagttgaattatgttcttcacagttgtgtcaccctggagcagttattacaggccccttcttccccactgtggtgagatcccacatcgagcttccttggctgatctttaagggggatgctgttgccattgggagctccatagacttggatcacttaacagctttgagagatgatataacttctagagacaatcttatttgcagctggagtgcagtgaataataatcatcacacaatgtagtttcctttttacttttctctaagcaaaataatgttcatacagaaatcag

SEQ ID NO: 265419 - DNA, 249 bp, Homo sapiens
cttttttttttttttctttctttctttctttctttctttttctttctttctttctttctttctcgctctcgctctctccctccctcgctcgttttctctctctctcgctcttgccctctcgctctctccctcgctcgttttctctctctctctctctctctctgtctctcgctctcgccctctctctctctctgtctctctctctctctctctctctctctctctctctctcccttctgtcgtcttctc

SEQ ID NO: 265420 - DNA, 206 bp, Homo sapiens
cttttttttttttttctttctttctttctttctttctttttctttctttctttctttctttctcgctctcgctctctccctccctcgctcgttttctcctctctctctctctctctctctgtctctcgctctcgccctctctctctctctgtctctctctctctctctctctctctctctctctctctcccttctgtcgtcttctc

SEQ ID NO: 265421 - DNA, 936 bp, Homo sapiens
gaaaatcaaggcccagagaagtgagaaggcttacctaagatcacaaatgaattcatggaaaccaggtctcctatctctaggaccactgctctttgttctacaccagtgattctcaaccaggggcaatttcatcttccagggaacatttggcaatttctggagagattttggttatcacaagtgggtggggttgggggatgctactggcaactgttgtgtagaggtcagggatgttgctaaatacactgcagtacccagaacagcccacacaatgaatcatctagcccaaaatgtcgaatgttggggttgaggaactcttttctacactgtacaattgtaaactatagaataacaataatattcaatagtaattatcatttattgtatgcttacaatgagctgaaaactctgctgacacttttaggcattatctcatgtttaaatagttctatccccctaggagtaggttttattatacccaagaaagaaaactgagacttggagaggttaagtaacatgtgtccgaggtcacatggttaataagaagtggacccaggactcacatctgtactcagccttttaaactgtggtttatgcatgtatgttgtgtatgtgtttttgtgtgtgtaaacagataaaacttgagaataacttcattttacagtgagttgtaagctagtggggcagatttgaaatgagccctttttctcctccatcctgaatgagacagagtctcataggaaaattcctgcattctttagctaactcaaagttaaggagatttcagaatctccatggggtttctcattttcctactgataacttttgttttagtttcaactaagtagagctaaaagaagcataggcctaattaaatagaaaatgtgaacgtttgttgtactttctctaataaaggcgcttgagaacaaaaaaaag

SEQ ID NO: 265422 - DNA, 814 bp, Homo sapiens
ggttggacagaggaagagacagaagattccactgtgcgtctagccttattcaaaaacaatgaaaataaagtgtctcttccaaaatcaccaaagatggtacagcccagaagagatggttactttgaaggtatgggttccatatttctttcacaggtatagaagaagaccctatccacaaagataccactgcaaatgaaaaattagaaaggaatagagaatatacataccaatggcttcacacacaggttggggttcatgaaacgactagttccagaaatatgaaatgcaatcactttttgcctgagttagatccagatgtacttaatggtggaagagttcagcttgtggtaagacttgtaagcagagaagacacggatttagaccttttttccatgaccaatggaagtgcttggtctgtgaaccagagacaacacaaacatcaggcacacagacactcagcaggatcttcaagtggttcagttaacgggaataccaatatcgcaataataacaatacaagaccttcttaaaaagaacgtaatatcattccgagacaatcctgtacaactcagcggtggatgcggggaagtgcgcaaaacgaaggcgaacatttcccactaatccttagggttcagcttcaaacatgtggcaactggtcctggacgctggttctacgccaggtcccctggtcacggttgaaccccaatcaactgggatatcaccgattccaagctggtccccaggggcaacctactcctcttaaaggagggcatcccgggtctgggaggcccaaaatacatagaggcaccactgaa

SEQ ID NO: 265423 - DNA, 622 bp, Homo sapiens
ggttggacagaggaagagacagaagattccactgtgcgtctagccttattcaaaaacaatgaaaataaagtgtctcttccaaaatcaccaaagatggtacagcccagaagagatggttactttgaaggtatgggttccatatttctttcacaggtatagaagaagaccctatccacaaagataccactgcaaatgaaaaattagaaaggaatagagaatatacataccaatggcttcacacacaggttggggttcatgaaacgactagttccagaaatatgaaatgcaatcactttttgcctgagttagatccagatgtacttaatggtggaagagttcagcttgtggtaagaaatgtgcttaaagttacagaaaaatgttgtagacactagtgctcaaataaatggcactttaagatatgtttataattaaactatgaaaatatcacaactgtatctatttgggataatatcaaaatatcatgtgttaaaataataacatgttttcttgacttgtaatacaatttaaaatgtgacattgcttaaaaatgttaattttatgtgacagatgtaaaaatattagcatcctacaactttaaaataaaattactgtggatggaaaa

SEQ ID NO: 265424 - DNA, 421 bp, Homo sapiens
gggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttga

SEQ ID NO: 265425 - DNA, 411 bp, Homo sapiens
aaaataatatcaagtaccctctcagaccacagtgaaataaaattggaaattaactccaaaaggaaccctcaaaactatacaaatacttggaaattcaataatctgcccctgaatgatctttaggtcaacaatgaaatcaagatggaaattaaaaaattctttgaactgaacaatagtagtgacacagcttgtcaaaacctctgggacacagcaaaagcagtgctatgaggaaagttcatagcattaaatgcttacatcaaaaagtctgaaagagcataaataggcaatctaaagtcacacctgaaggaactagagaaacaaagaaaaaccaacccaaacctaacagaaaaaataagtaacaaagatcagagcagaaccaaatgaaatcaaaacaaaaaaatacaaaaaaaa

SEQ ID NO: 265426 - DNA, 504 bp, Homo sapiens
ccaagctctcctttctaccatttagccaccctggcggtctttcggataacaagaaaaatccaggaaaaggcagcaaaggaaaagcagcgtccaaaaggctgagggagactgtcaccctgtcctctaagtgccaccaagacacagagcctgagcgcagggacgtcatgtgtatgtcccttgcacctgggcctggtctggcccgcagcgggggctcaagaaacagctgctcaccgagagtggtggctcacacctggaatcccagcactttgggaggccaagatgggaggatcacttgagcccaggatttcaagaccagcctgggcaacacagggaggtccctcaaccctacaaagagtcaaaaattagctgggcgtggtggcccacgtctctggtcccagctactcgggaggctggggagggaggattgcttgagcctaggatgtagaggctaaagcgagttgtgattgtgtcaccacacttcagcctgggtgacagagccagtca

SEQ ID NO: 265427 - DNA, 549 bp, Homo sapiens
tgtgttaggtacctttataaagttaggaaagttttcttctctcaatagttggctaaaacttttaattaaaagttgagtccagtaatatttaaaggtttttctctatgtattgagattaccatatgatttttttccctttattctgctaatgggaaagattatgttactggagttattaaatgttaaaccaactttgcatttctggaagaaattgattcaggttaagatgtataatctagtttttgcattgctagatttggattgctaacatttggtttaagatttttttccctctacttttggagggttcaaactcaattctttcttttgttgttatcccagaaatagtaagatgtatatgtaacttaaaatctgaagttgagcattatcttcacctttctcctggataatgcaaggattttagagcgctttgcctctagctgacactttttctagtttatatgctgttattcattattttcaattctatcttcttttggttcagattcaaaagcagacaagtaataaatatttttatcctttatgcac

SEQ ID NO: 265428 - DNA, 591 bp, Homo sapiens
atggaaaaacctctggaaaacctttatttatgttgaataagtattccttgaatccttcctcagcatcctgggttatatttgatttgctctgctcatgataacttcatgccaaggagactgctatcagttctcttaaaacagatcccaactccctgctcatagtggccaaaggaatggagatttcaggctgagtttacttacgtgcatcatcttcatctatccagaagcatccctgcacaaaacctctgtttctacccttccattcactcggctcacttttctgctcttagtaccctttgtttcttgtgaactctccagcaggagtgacttgcaatttgtatccactgacacttaagttctcggaagtgctggagaagtgtatggaagtaaattatcctgatgtataattttgtgcatgtgaaactcaccgtggaagtgcctatctaatttcagtatggaacacagctaaacatttggatcaataatccagttttgaaaccacacttcatttaaagtacaatgtgctgaaaaaaatgaaaaaagggtgctttcaaatttgtacttagtaaactttcactagatcacatcata

SEQ ID NO: 265429 - DNA, 204 bp, Homo sapiens
tccaattactcaggaggctgaggcaagaggatagcttgagcccagaaatttgaggctgcagtgagctgtgatcccttcactgaacgccagcttgggcaacagagcaagactgtgtctattaaaaaataaaaaaatttaaaaaattacatgttctgtcgtcaggtgatgaaggaatggtggcaagcgtgcaaactgaaaaaaaaa

SEQ ID NO: 265430 - DNA, 455 bp, Homo sapiens
ctcgaggccaaaaataaataacagaaatgacaacttccatttaagctgacttttggaaaacaaaaactgtctacatttaataatctatttagttagcattattaatcgtaagggcctacaataaccatttcagaacaaaacagatcaacgtgataatcaaaatgcacacttcctactttcaaaggcaaaatgttaaagagttttaagattagagaagttactgatatggaaagaatgccgaaaaccccaaattgacaatttattaggtatttcaatatacctaaaatgcaacatctaaaatagtcccgaaaagtaaaacagctagttggtttcacaaaaaatttccagggtgcatttaaagaccagataattccactgttccaaagcacagaaaaagactagaaatattctgagtatatttatgaagtaagcataacatcataacattgatacca

SEQ ID NO: 265431 - DNA, 394 bp, Homo sapiens
aatctctgcactacattttctgtatactttacccctgggtaaaaattggtgagtatttaaatgcttcctcacataatcttgctaaagcacactcttgcctataaatattcatgccactgccaaaacatttgcaagctttccccaaaggtgaaatgtgtgtaatgtactttgtcttctgggtataaatattatccaatacattttggttaatatgaatacactaattattcctgcaacccttttaaaaagggtcatcttcatgatgtgaattttttaaaaatgtaattacaataattggatacttaatctaattaaaatttgctttatctttaatgggaatttgtctaaagaggcagaatgacaattggctttttgataatgactgttttctttc

SEQ ID NO: 265432 - DNA, 405 bp, Homo sapiens
gcaaggacatgagagaaaaataactaagagctaaaaaagaattctagaaggttgggcaagataatggcttagaaaataggaggtcatttattttattactcttcaaaaacaacaagagatgacatttgaaaaccatgaagctctttccttgacaattctggatattagacctttgtcagatgtataaattgcaaaaacgttctcccaatttataggttgcctgttcactctgatgatagtttcttttgctgttcagaagctctttagtttaattagatcctatttgtccatttttgcttttgctgcaattgcttttggcaatttcatcatgaaatctttgcctgtacctatgtcctggatagtattgcctagattttcttctacagtttttatagttttggattt

SEQ ID NO: 265433 - DNA, 514 bp, Homo sapiens
acgaagccccagctgatctgggccagggttcccccgactcgtcctctgggggccgtcctgggtactgcagggccctgagcagcgtccctggcctccacccactccttgccaggagctccccgagtcgtgacaaccacagatgtcccagacaccgcccggcgtctgctgggggcaggagtgggaagcagaagtctaaggtgtagggtggctcctgtctctttctggagacgttccataaatagaatctttcctgtattaacaaatgctcacacgccttacaaaccgctctgtgtaggagccgacacagacggagccctggctgggctcccgctttccattttgcaatcagggaaaccaaggcccagaggccaccgtcacaggcagagctgacgttccagccccggcctcctcctccgagcccagagcttgctgccttcctcttcctcctcctccctcacccgatgattctgctgggagccgcccgggagcccaggaggggcgggtatgcggccgc

SEQ ID NO: 265434 - DNA, 446 bp, Homo sapiens
tcccagcactttgggaggccaaggcggatggatcacctgaggtcaggagtcgagaccagcctgccaacatggcgaaaccctgtctctactaaaaatatagaaattagttaggcatactggcacatgcctgtaatcccagctactggggaggctgaggcaggagactcacttgaacctgggaggcagaggttgcagtgagccaagatcataccactgcactctagcctgagcgacagagtgagactcagtctcaaaaaaaatcaatacaccaaatagtggagtttccctattttttcaaatagaaatatttccatcaaaaccttttgctctcgaatacaaactaatactgagataaggaataattctggcgtgggggtggaggagtctgtttctggcctgttgtgctacctgggtcacatatgatggagaataaaacattaattttg

SEQ ID NO: 265435 - DNA, 434 bp, Homo sapiens
gcatgagccaccatgattggcccagtgactcacttaaatgaacagatgcaacataaatggtgctgtgtgacttccgcggctaggttagaaaagacagcacaccttcttcttggtactctcttttgggatgcttgctctaggaacccagtcatcatcctgtgagaaggcccaggccacatggagaagccatgtatagatatcttagctgacagcctaggcagaagtctcagctgtcagccaacatcaaattccagacgtgtaagtcaggaagccttagacatgatctgtcctatggctacttgtatctgcaatcaggtgagtgagtcccagcacaaactgcctagctgagcccagtcagccactagatctgtgagagaacataatagcaaaataattgttgtttaaaaccactttgttttggggtgatttattac

SEQ ID NO: 265436 - DNA, 351 bp, Homo sapiens
ggctgctgactcgctgccggggttcatttctgtctgctttctttgatcatcagcgcagttttgaccatcgctgttttctcagttttcccatcttagagccaaggaagaaaaagttgaagtcacaacttttaatcccaaggaacaagaaccaggagacgagggctttccgaggagggaattagcaaagtatcattttcctttgggtctagaatcgagaaaagtaaacaggacttgctgctgaaacctgaaatcccatcaaagagaattcccggcggccgagagcgttcatgaaaaacgcggaaactcggacaatgagtagggcgcagagtcagaaatttatagactttggcc

SEQ ID NO: 265437 - DNA, 541 bp, Homo sapiens
cctgtgaggaattggcctcctaggcacaaaaggtgaactggaacccaataggtcgtggcccccaacctggaacttctcctgggtctgggggtaggttgtggctccacctagtgtcctttggtggcaactgcaccctgggctgttcacacccaacagcccagcagccaggacagccctgctgttccctaggtaggccccctctgggctggcagagcaaggataagggacagtgacagccgaaaactaggccctaggaggagcccctgagacacattccatctcttcactccctgcatgcccatattgccagccaggccctgcatgcacagacagatgggtgttcaagtgccacttaccaactgtgtgaccgaggagagagctgagtctgtgcctctgttgtgggactatgggtgatggcacagagtcccagccccacctgtgagcctccccagctgtagctgcaccattgactgaattctgattctggcaggtcccctgctaggtgccttaccggtgtaatctcagttgatggtcacagtaa

SEQ ID NO: 265438 - DNA, 446 bp, Homo sapiens
aggcatttataaacatatgttgaatgctgaattgttgaacatttgaacatctccagatttgttatttttattatcctgtctttgttaccttgaattggttaatagcaaaacctttagaatcagagactctgtgtgcttgttatggggggcaacaatgaaagtcagggtgcagctaatgagattgtattttacttatagccaggattgtggaagaagacactcaaaggataagaggcttaccatttttcccattctgtaaaaccatgttgatgacaataccaattctgagagttgttttgaaatactgagttaatatatgaaaagggtctggtacatgatagatagtaattgagatgtttttgttaccagtattattatcttcacaagtggggggcaaacacagagatcccagaacctattataagaaaaaaaggaaaacatctgga

SEQ ID NO: 265439 - DNA, 1525 bp, Homo sapiens
  misc_feature (790)..(790): n is a, c, g, or t
  misc_feature (797)..(797): n is a, c, g, or t
  misc_feature (809)..(809): n is a, c, g, or t
  misc_feature (822)..(822): n is a, c, g, or t
  misc_feature (884)..(884): n is a, c, g, or t
  misc_feature (902)..(902): n is a, c, g, or t
  misc_feature (936)..(936): n is a, c, g, or t
  misc_feature (938)..(938): n is a, c, g, or t
  misc_feature (968)..(968): n is a, c, g, or t
  misc_feature (986)..(986): n is a, c, g, or t
  misc_feature (1408)..(1408): n is a, c, g, or t
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctgganttttcantttcctcatccnttcttaccaaacnttgattttgttggaggactccactgcaaacctgccaaacccctacctaaggaaatggaggantttgtacagagctctggngaaaatggtgttgtggtgttttctctggggtcantnataagtaacatgacagcagaaagggccaangtaattgcaacagccctngccaagatcccacaaaagatataaagagaatgttatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagatgggatgacttcagtttattccagcaagaaagaaaagattgttatgcaagatttctttcttcctgtgacaaaaaaaaaaaacttttcnaaatctaccttgtcaagtaaaaatttgtttttcagagatttaccacccaggtaatggttagaaatattttgtggcaatgaagaaaacactagggaaaataaaaaataatataaagcc

SEQ ID NO: 265440 - DNA, 1772 bp, Homo sapiens
  misc_feature (790)..(790): n is a, c, g, or t
  misc_feature (797)..(797): n is a, c, g, or t
  misc_feature (809)..(809): n is a, c, g, or t
  misc_feature (822)..(822): n is a, c, g, or t
  misc_feature (884)..(884): n is a, c, g, or t
  misc_feature (902)..(902): n is a, c, g, or t
  misc_feature (936)..(936): n is a, c, g, or t
  misc_feature (938)..(938): n is a, c, g, or t
  misc_feature (968)..(968): n is a, c, g, or t
  misc_feature (986)..(986): n is a, c, g, or t
  misc_feature (1408)..(1408): n is a, c, g, or t
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctgganttttcantttcctcatccnttcttaccaaacnttgattttgttggaggactccactgcaaacctgccaaacccctacctaaggaaatggaggantttgtacagagctctggngaaaatggtgttgtggtgttttctctggggtcantnataagtaacatgacagcagaaagggccaangtaattgcaacagccctngccaagatcccacaaaagatataaagagaatgttatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagatgggatgacttcagtttattccagcaagaaagaaaagattgttatgcaagatttctttcttcctgtgacaaaaaaaaaaaacttttcnaaatctaccttgtcaagtaaaaatttgtttttcagagatttaccacccaggtaatggttagaaatattttgtggcaatgaagaaaacactagggaaaataaaaaataatataaagccatatgagctcatattgaaatttgttgcacttatattgagatttgttgtttgaattcacaagttacatgaaaaaaattttactcagcttaactatatttcacacattttacataaacacaagaacattaagaagtctactgacagtatcagtactgttttgcacatactcagaataatttgcttcattttgaacagaattctgttgttttaactgttgctaaagaaagtattacatagttaaattgta

SEQ ID NO: 265441 - DNA, 388 bp, Homo sapiens
gtctgagtgacagagcaaaattccgtctcaaaaaaaaaaagaatctcaaaaaataataatgagcaaaattagcaaatcacaaaacatatgctgtgtgactccctttatgtaaagttcaaaaacaggaaaaactaagcaataatttgcttaggaatgtatacatgtgtatgtgtgcacatgtaaaactatctagaaaagcaaagaaataattttgaaaatctcaagataatggccacagtaagagagagaaggatcagccaccaggagggtaatgtaggatttctaagggtatagttaaattcaacctcttaaaccaagtgctgggtacatggaggtctgtttttttattattacttaatatttattaatattattatttaatagtaaa

SEQ ID NO: 265442 - DNA, 610 bp, Homo sapiens
aagtataccggagatgtgaactgatttataaaccaacctacagactatcttctatcttgctgcatttacagccaacatgagattatgtatgtactgactgatgatgggcaatgtaattagctttagagttgttaagagttaaataattaatatgttaataaattgttaagagttaaatcattaatatgttcctagacatctttttatcggttcatgttatttagttcaggcttgcttggtaactgaggaaggaaactgttttcccaacctcgcatatcctcacctgttccctacccacatattcatctcaatgtaaagcatgtttgggacttgctcaattcagccaaccccaccctagtctggctatcacccccttcattgccaaagttctccctcctttactgccaagtttcttgaaagagtgaagtttattatctctgcttcctcacctcttcaacatttctcaatctggagcaatctggctgtttccctccacctctcactaaacctctcctcaccgagtctttgctcacagtggctaaatccaagtagtgtttcttgatccttctgctgtatgctccacagctgccctgtccaacacggcggccgc

SEQ ID NO: 265443 - DNA, 552 bp, Homo sapiens
ggcctggtcctatttcaaaacaggccgcaaagaccaagatagccccaatacagcaaaagctcatccctattatagtgattctttaataacaaagaaacagtcatgagcgtggaacaaaaagccatccctcccctcgtgccgaattcggcacgacatgggttcccgctgtgccaagctcaacacaggccagagcccaggccacagcccaggccacagcacgggccatggccggggccacgaatcctccatgaaaaagctcatggcctgtgtgagtcaggataacttctccttgtcatcagcgggcgaggaagaggaggaagaggaggaggagggggaagaggaggagaaagaagagctgccggtgcagggcaagctgctgctgctggagcctgagcggcaggaggagggccacaaggacaacgccgaggcccagcagagccccgagcccaagcagacaccctcctgacccgcaacgaaggcccaggaagggacgcccactgctgctccggcgacagtgttcagagaagagtcaataaaaagtctctgaggaat

SEQ ID NO: 265444 - DNA, 522 bp, Homo sapiens
tctggtggtgacatggagccttgaggatgggactatacgcatgagactgggatcagagtggaggcagctggcaaggaggcagtcaggagaccctactaatatagggaatccaaatgaaggagaaaaatcatgatggcacagctagaaactaatagagaagaaaaaataccccaggcattttggccttgttttacaacatatttcttagctttttgatggcaatggaagcttttttgaagttgtcttttgtttcctgcctttactgtatgctctgaattcccttctctttcatgctttttggtttgcatctattctttcatattggaggctttgctcaaacattctgtggaccttatctgtttgcatatatttaaatgcaaggcactgaaagacaaaagacctattcaaggcagagtacaaagtggaccagggcaggctgatttctcaacctctctgtcgtgagttgactcgtgtactcccaaaagctatgttgaagttctaaccccggtacctgtgaatgtg

SEQ ID NO: 265445 - DNA, 352 bp, Homo sapiens
ccccacaggtggccgagcacacacagtccagtgggctgaggtggccccaagggcaggaacgtggcatctcttcccaccagtcagtggctctgggggcacaaggacttgtcgggggaaggaggcagcaaccgcaggtcagaagctggaagcagcggccactcagcaaatgacacagctgagccggaaaacccagtcccagggctgtgaagagctggggccggcctcacgggggctccccagtttcccctgcccggccctgggccggcctcacgggggctccccagtttcccctgcccggccctgccctgccctgccctgccctgccctgccctgccctgccctgccctcccct

SEQ ID NO: 265446 - DNA, 300 bp, Homo sapiens
cactggccttgtcctcaagatctctctctggctccctttgaatttgctaattcagactttcacatttcccccaggaaaaatcataaggaccaaatcatatccgttttctcaaatggcttcaaagacccatgtcatcgtttggcatcatgtaattctttactgatgtactttaagagtcacgttttattctctttatgcagctgtcaaggacagacacaaagagtgggggtgtcttcctcactaaatactttcccacaacactccagagtagattcatcatttaaataaacactaacagct

SEQ ID NO: 265447 - DNA, 430 bp, Homo sapiens
tttttttctcagcagtaactacattcctctgagatagcaaaccatcccattagaagaaatgaataacttgtttgtatattaaatctgtttttattagaataggggttagtgtggacattcatttaggtgactctgtggaataacttaagaaaatgtattatctaacagaagaggccagactttcgataaagaagatcaggtctttggttctggatgtttggtcttgttttcttgtttggcggttttggggagttttgctctcttttattttattttgtcctccagatgaaagtggggatagatgctgttggtgctctgcccacatcccctttactgagcaggacacaatcccaagctgccatgactgttgtctaccaatgattcacagctgccactctctccagagaattgtctttagcagacaagggtc

SEQ ID NO: 265448 - DNA, 294 bp, Homo sapiens
agggaggggtggttcgcaggcagggagcttgtgtgcccccccaccccactcacagccaacttcccatgagtgggtttaagatcatcaacttgttgctgagatgacttaaacatgatagatttcagcggtaaataatttttacattctggatgaaatgaaaccagacctcctatttaattttaggtaactaaaagcacttagctgtaataaatgaagctctgttttccaagtcaaaagtcactgctccccaagctcccacaaactcagaattctatgcaaccataatgcactttc

SEQ ID NO: 265449 - DNA, 521 bp, Homo sapiens
ctcgaggccaagcaaattggggaagacttcagaacaatcttagaaaggtgaaagcagcttagattataggattctgttaaagagcactccactccccctgaaatctctctgttccctctacaattccacaggcctctgatagagattactccaaaaattctggcaccacataagtctttggcttttaaatcagtttcaccctggggtatcttgacagcaggattgacagagcttatccctgactgtataccacaaaacaaacagataccagcagggtaaaggcaatttgtcttagtttgccatgaaaatgactaatattgattactctctgattcacagctgcagtcctccaccctgatagtaacggtttagtgctgcaaactcttctgttctgttgttatatgggacataatatatagataagtctgaaagccctaaaggacagcaataaaagtgggtggacttctcttcaataagtgtctaaagcaggtggccacaagcaccctctaacatctcaattt

SEQ ID NO: 265450 - DNA, 293 bp, Homo sapiens
tttactgagccagagaactttgaaaaggcatagatttaggggatgaaggtgatgagctcagtttgaggtttgaggacagatgagaagcaggagacagaagcaggatatctgagaacaagatggcgcgagaagcaggagacagaagcaggatatctgagaacaagatggcgcagctgtggtttaatgcatgcccagcatgtgagaacttgtctggaggttccagcagggggcgctatgactcatgaccgtgcctctagctgggctcctcatgcttttcatccaagcatgtggcc

SEQ ID NO: 265451 - DNA, 300 bp, Homo sapiens
ggtttggccaaacagtcctggtttacctagcacagttctggtttgctgattgcctggtgtaatgattaatagcactgtcactccccaaattgtcattgtttggataatgaattatatgcatcctttttagagtaaaagtaacttttttctccttaaactggatggagggcatgtgggtctttatcattcttccttatacatgtatttttaaaatataatttaaaactagtcagtattttaaaatataatttaaaactttagtcagtgttagtcactgtgttagtgacaacacagtaaaaa

SEQ ID NO: 265452 - DNA, 186 bp, Homo sapiens
cacacagacaatgtttaagaaatgtttgttattgttattactatgtctctgtatatatgcctaggaaaaatctggaaggataaaataaaaaatgaatatttttgggtggtgagactaaatttttgtctaattttatggataagttttatgatttatatttataataaaaataaagctataaaaatt

SEQ ID NO: 265453 - DNA, 495 bp, Homo sapiens
atatcagaaatgaactcagaagagaagaagactaggctgcctgaagagatctcaagaataatcgtagaacgtgctgagaattcaacattctgaggtataatatctcagttagcctatgaagagaatgttgtggatctccctccaactcacttcacaagtatttagattcaaggctgggcacaggaagcagatggcaggtacaattgctgagagttgcaatctggtctcagcaaaactggtatcacagggacataattcacttatgctgacgtgcaggtgcttttgcgaaaacattgtcgtgtagcagaaagagcatgggctttggagtcacactgacctaggttgaagtcttagatgagttctcactttagttttctttctttaagatgtagataactcctaccttgcaccatgatttgaggactaaataaggaaaataatattaagttctatagcaaccctgaaacacacacattaaaagtatgtcttttcttc

SEQ ID NO: 265454 - DNA, 392 bp, Homo sapiens
ttcgtggggaacattctgagaattaaatatagtaatcaatatagaaattcctggaataatccctggcagagtgtagaccctcaaaacatgttagatcttaacatgattcctccttaagcgtcttctacctgaaagaatcttttattctattcatattttcataattcagttggatttttggaggtatgaactgtgcctttttgtatagaaatatctagcaaaggtaatttggtctttaaattccttttactttcttggtattcattgaagaccaaagacgctttgttcatgtggatccttgaatggattgttgctgcttaccttatcttcctctcccacctactcctattgaataagggttcataattatccatctaaaatctacagtaatt

SEQ ID NO: 265455 - DNA, 267 bp, Homo sapiens
tttttttactgtttttctctgccattcactggcacaagaaatgatttctctaaaatataagttttaattgtggaataatcttggtaaaatggttttgtggttcctcatcttgtataggtaaaacctaaactccttttctttcaaggtctccagacttacctatctggtcttatctcctgccttcctgttctaagctcttttgcagtttagctgctattttcccattcttattcctactccctgatatctcttctgcctgtctaacac

SEQ ID NO: 265456 - DNA, 237 bp, Homo sapiens
tggctctccttcatgattgacatggtgtagagtttgcaaccaaaaggtaaaaaggggcaaaggttgggcaggtctggacctttctccactatcatgaattggggagcagcctttagaaggcagcagctaccaggttgagcctcccctcctcagggtaggtaagaagcagagaaagttgagacatggacaagagagggactaggaagaagtgttaccatgggaaccagatggggtcct

SEQ ID NO: 265457 - DNA, 596 bp, Homo sapiens
agagaattggagttctgttaagggagaagtagagaatcaatactgggtaatcacctagtggtctctgccatagcaattgtctgatattctgcaattgagcatatttcaggccgtgaacatcggacatggttttgtcttcacaatggcagcaaatttagataaaattttgtttggggtcatcttgtgtgcatttcttctgtatcttcagcatggtctgtgcctttgtctttttgcagtatgtttttcttcctattgatactttctcttgtctcactaagagctttgttctttgataaaataatacagattgataaattccacaaaggaaaacaacgcactgaattaaaacagactatttaaatacagaagcagcattctgttcagataattctcagtagggccaaatctttgttcatttttaaataaaatgatctattcattcacattaatatgtgttaatgaaattaatgtggcatggtacttaatattattaattgtgttaaatgttcatgcttccatgagggccatttaagaagaggtactcagttggatatacaggtagcatacagtaacatttaaaacttctatcgtgtata

SEQ ID NO: 265458 - DNA, 287 bp, Homo sapiens
cccacagttccatcccctctagacagcagcctgcctcacagtggtgtcccaagagcactgggcgtcaagaggtaaaatgcctgggcattttctctgaagcacctgttaccactgtcccttcaggctgtgattcctggccaaaatgcacccattctttttgacacacttgggagggtctgggattgtgagacttgcagaagggtcagatgtcttgagtcactgagagggctgaagaaggaatatgtagtctgcttcttgacatttgttactggcccgggcctgcccca

SEQ ID NO: 265459 - DNA, 852 bp, Homo sapiens
tggctaatttttgtgtattttttataaagactgggctttgccatattgcccaagctggtctccaactcctgggcccaagcaatcctctggccttggcctcccagaatgctgggttacaggcatgagccaccgggcctggcctgcatctttatttaacatgttccttcaaacagctcactgccaaggtcatttctttttctcagaaccatacttcatttatttaagagccctttccgattgcctcccccagaccagaatgcagtcactagcgtgataagagtctttatagcttgaagtacctgctgttctcttttcttttccctactggtcttatgtacaccaatctgggtatccaaagccctttccttcatatgtacccacttcctggcctgagataaacacatttctgggatccgccatcacatacctaaatatatccaaatatatccttatctttctgagatttttgagtgatttaaaatttttcatcctttttgtatgttccagaatttctaattttttttttttttttaaacagggtctaactctgttgcccaggctggaatacagtggtaccattctccacccactgcagccttgaactactggaccaaagctgtcccaccccagtctcccgattagctgagactacaggtgcacaccacgtgcccggctaattaaaaaaaacatttttttggagagatgaagtcttactatgttgtccaggctgatcttgaactcctgggctcaagcagtcctcccagctcggcctctcaaagtgctgggattacaaacgtcagccactgcacctggccctgattttttttaagaaaggagcatgttttttaatca

SEQ ID NO: 265460 - DNA, 441 bp, Homo sapiens
cttaatgatattacaggtctaacaatgatctcaaacttaagaaaaattagaaattctttttagtcacatactgtataaaaattaaaaactgattcaaagagcaggcatatcataactaacaggaaagtccaaaaatttgatcacaggcataacttccaagttttacatgtccagctaagtcatttctctaattggaacactggacaaagaaatattcaaaagtatcttcttgagcctggcacagtggcttacacctggaatcccagcactttgggaggccaaggcacgtggatcattagaggtcaggaattcaagaccagcctggccaatatggtgaggcctgtctctactaaaaatacaaaaattagccaggtgcgcacctgtaatcccagctactcgggaggctgaggcaggagaatcgcttgaactcgggagatggag

SEQ ID NO: 265461 - DNA, 425 bp, Homo sapiens
gtgacagagcaagactctgtctcaaaaaacaaaacaaaaataacattagaaagtaatagatgaatatgtttttgcttgattttatgagtagacacatgggaacaattcctaagtttgtcttgagcactctataaatagtttaaaagaaaaccaacagtgcttaaaattcaaccaatacagttagaattacgacttgaaaagagggtatggctattacatattgctgtaatatgttctactttccttacaggagaaaaaaaattagctgggcatggtggcacgtgcctgtaatcccagctacttgggaggctgcagcaggggaattgcttgaacccggaaggtggaggttgcagtgagctgagattgcgccactgcactccagcctggcgacagagcaagactctgtcccccctaccaaaaaaaaa

SEQ ID NO: 265462 - DNA, 518 bp, Homo sapiens
ctgtaatcctaacactttgggagaccaaggcaggcagatagcttgagcctaggagtctgagatcatgccactgtgctccagcctgggggacagagtgagactccatcttaaaacaaacaaacaaaaactaaggtggtattaatcagaactagaatgttataaatatatgttaattgtaccctcaggggaaatcactaaaaaaaaattcaaaaatatatattaaaagagatgacaatgctgggcatggctagctcacgcctgtaatcccagcacttcgggaggccaaggcaggcagattacctgaggtcaggagttcgagaccagcctggccaacatggcaaaaccccatctccactaaaattacaaaaattagtcaggtgtggtggtgcacacctgtagccctagctactcgtgaggttgaagcacgagaatcgcctgaacctgggaggtggaggttgcagtgagctgagattgcaccactgcgctccagcctgggtgacagagcgagactccgtctc

SEQ ID NO: 265463 - DNA, 384 bp, Homo sapiens
ctcttgctcttttccttaccaaaatttggtatgcatgatatatatttttaattttagcattctgtggttgtaaagaggtatctccttatggttttcatgtttatttccctaatgaataatgagattgagtatattttcatcatccttactttgttatgtatatttccatctgcctactttttaactgatttgtcttcattataaataagtgatataaatttttatactggttacaaatctttttcagatatacgtattttaaatattttctactagtctgtaacttgaaattaattttttaagggcaagttttgatgagcagaagcattaatattaatgaaatttaatcaatcattttcttcacattttaagaaatctttatcc

SEQ ID NO: 265464 - DNA, 354 bp, Homo sapiens
gcctgtagggaagggggccacattaactttactgataaacatataccgaaaggtttcaacatgtggatattttctagctatgtggcagcgttcttgctctttttaactcaacagcatatattttcaaaataaccttacataaaaagaattataggaatatccaagctagtgtgcataaatgagacaatttcaaacaaaaaaatatatttgtacattttcatattatacctaatcatttaagctgtttagattctgtatgagagcaaatgaagattttcactgcgcaatacttgttatgttttgctttgcttttataaaagcagaagttacttcataaaatatgtatgcatgttc

SEQ ID NO: 265465 - DNA, 485 bp, Homo sapiens
gagaaagagtacgctttggaagacttgctgcactccaggaccgtcactagcgtgatggctgcaactatacccaccctaatatctgtcaacacgagcaggggcaacttaaactctcaaaagtctcagggttctcacccataccattagggtgacgctcgtgtgcatcttctgtggctgatgggtaaattaaacaggacgtaatgtgtagcgtactgcatgtggtggtcattggtagctgtcagcagctgtaacaggagaagttggctgtctttatttcccctcgatggaccaagcagctgctggatcatggccacccagcccctctgaaggagtgctcggaggaacacaagggggctggtcttccaagaggagccctctagcatggcagtggacggggttcaagcccctctgatttattatcctcattctgcacttccctgtagcaagtcacatttttttctcttagcaataaaatggggccttca

SEQ ID NO: 265466 - DNA, 625 bp, Homo sapiens
agttcatagatcaacagcatcccaagccagaagaatttttcttagtacagaaccaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagatagggtctcactatgttgcccaggctggtctcaaactcctggcctcaagcaatcctccttccttggcctcccaaagtacagggattataggtatgcaccactgcatctggccacaaacattttgttttcttactgttcatttttcaagacaggttttcactccagcctgggtaacagagcaagaccctgtctaaaaacaaagcaaccacacacacactggaggacaaaggcaatgagatggtatattcaaagtgctgaagaaactgtcaaccaataattctatacctggcaaactacctttgaaattgaagagaaccgtcgattcgagggaatcctctggt

SEQ ID NO: 265467 - DNA, 527 bp, Homo sapiens
atgtaatgtgtgacaataacagtataaaggagggggtgagagtggagctttagagaagcaaagtttttgtataccattgaaacaaagttggaattaatctgaactacaacgttataaaattaagatgtagctgagactacaggtgcgcaccaccacactcggctaactaaaaaaaatttttagagatagggtctcactatgttgcccaggctggtctcaaactcctggcctcaagcaatcctccttccttggcctcccaaagtacagggattataggtatgcaccactgcatctggccacaaacattttgttttcttactgttcatttttcaagacaggttttcactccagcctgggtaacagagcaagaccctgtctaaaaacaaagcaaccacacacacactggaggacaaaggcaatgagatggtatattcaaagtgctgaagaaactgtcaaccaataattctatacctggcaaactacctttgaaattgaagagaaccgtcgattcgagggaatcctctggt

SEQ ID NO: 265468 - DNA, 317 bp, Homo sapiens
gcagtttcactcctgagccagcgagaccacgaacccaccagaaggaaggaactccaaacacatccaaacatcagaaggaacaaactccagacatgccactttagagagctgtaacaatcactgcagggtgttctcagcttcattcttgaaggcagtgagaccaatgaacccaccaattccagacacactaacactttgcaagactgagctggaaaggatcacttgagcctaggaggtcaaggctacagtgagctatgatcacagcactgcactccagctccagctggggtgacagaacaagaccatatctcttcaaa

SEQ ID NO: 265469 - DNA, 591 bp, Homo sapiens
cacgaggatgaggaatggaatcagaaaacctaagacatgcatctgtgtgatagcaatctcactttcctcacttagctttttctgtttccctactctgcacagattggagacatctgagttttctctgcccccatcacctgcacctgccctggtggcatgcacttgcacctcctctgtctggtattaggttggtgcaaaagtaatttctgtttttgccattacaactgcataaactgcgattacttttgcaccaacctaataatagggcttgcccctccagaggatagaatctttgcttgtcaccttagaacttctcacacagagcactgcattcatcaaaccctggtctcagccatcctcggggcacatggaaggtcatgcccataaatcaatgcctcagccaacatctggtctccccttctgccattccctgtgtccctgccctggcaccaggcatttgcaggtgcagggggcaacatcatttagttagcttcatctgggcagggaggagcattattaaacatgagagatagctgttggctcatggaaaagattagttttaagctatttaaggcaaagcaataaaggatg

SEQ ID NO: 265470 - DNA, 364 bp, Homo sapiens
tcggctgcctgatatctgtgtctttcagggcagtgggaaatattccagctgcttcttcttttttttttagaaataaagttgtcatcttaatttcatttttatagggtttattactagtgaatagaaatagattttgtggccaggtgcagtggctcatgtctgtaatttcagcaatttaggaagccaaagtggacataccatctgaggtcaggagttcaagaccagcctgactgacacggagaaatccagtgtccactagtgaggcaggagaatcacttgaacacaggaggctgaggcaggagaatcgctcgaacccaggagacggaggttgcggtgacccgagatcgtgccattgcattccagc

SEQ ID NO: 265471 - DNA, 1288 bp, Homo sapiens
agctacagcaccgacctccaggagttggtgcagtggcctggggtggcagccggtgtgcctgattgccctggtcgggcgttcagggcagggagcagaatggccactgcagaagggatgtgcctgtgagtggtttgtccccagcaccaatctgctgtttgcggacatactatgggcagtgggtgctggccaagagctgcacgtaggttttctgttgactgtccatgcagggctacatggcccatactgtcagccccagctgtggaagtgggggctcatgaatggagtttctcatccaaggtcagtcgcgctggtggacggccctggctggaggcctacatcaccatccagggactccccacagtggccctcctgttgccctggaggctcaggtctctgaccttccatctcccatctgcaaagcactggacactggggttccgggcagatgcacggagtggcctggacatgcccatcacagccctaggataacccagacgggccatcgagacctatccacactctgtggagaccaatggaggaaacagctcagtttcaggctgtgggcgtctgaatcaaagcggggactgggaacaaggtgctcagcggacactcagcaaacggcctgaacgccgacgcctctcccgtctctgtctcctgtcttcacaaaaggaaaacggaatgcctttctggcatccacccagctttcccggatcccctgccagttgtcattttcagataacttgaattttatattttatgccaggatttttaagcccccaggatcttttcacatctgcacagcttggcttggaatcctcagctaggaccatccttcctccccaagaaccagggcctcatctagaaggtagggcagggaaatgagggtccacatgtggtccggcccctcggcatacagggagatgaccaggcctgggaaatgtgcccttcgacgggctggtgacaaggccaaaaagctgggcaaacacattgcagagatcctcccaaactaaaaccactgagagtacaagtgcaaaacattcccttttaagccagtaggggcttgacagctggagaacttgaaaacaacagggcacagttcacaaaatcaaaactcatggaaaactctgcgcgggtgagtcagagtgccagcgccaagtttcctggcatgcaagaggaggctcccccgctcaggcagatttttttaaacatctttttaataaattgaattgagacctaatttacataaaataaaactgacccatttaatatccagtttaattatcttgga

SEQ ID NO: 265472 - DNA, 453 bp, Homo sapiens
  misc_feature (28)..(28): n is a, c, g, or t
caactgcaattttattttcttttgtganaataaacaactgggagtttaaattgctccaaaaaccataaaaacaaaaagaaatacacacagaagaagcatgtgaggtgatggggaagggaacagaaacagctcattgctcaatgcccaaagatagcacgttgggcctcaggagcacctactcaatttagccactaaaaaattagaaacaaccgaaatgcccccaaataacagaatagctatacaaatgatgatgcctccgaatgatggaatatttggcaaccatcagaaagtttgctttttaggagctgggtgtggtggcccacacctgtggtcccagctactcagaaggctaaggcaggaggatcccttgagcccaggagttcaaggctcacaaatgtgaacagccactgcactccagcctggacagcatcataaaactctatcactttaaaa

SEQ ID NO: 265473 - DNA, 673 bp, Homo sapiens
tgtttttcagatgggctgtgggagggagctgctttctaattcatcaggtcctaaagggactttcacgtgagagaactaatccaaactcagtgatggtgcaagggtacttcttacctctagggacagtctcgggtatgtcttcatcagcagcatgaaaaaggactaatacacccagctacaaactatcccttaagctaaatatgactggcttgaatggagcaactgtagaagtaatcagaatccccaagtgagtggaacaagtcagttctaaaagggagaaaaaccttgggaatgctggaaacagacagctcaatgggcatattcagaagaaaacaatagataccagtcttttccaaagtgtggtgtgaagagtactgctcctgtaaatttaacgaaattttccatgggcaagaaaaaagttctaggaactcctgagaactgagaaatgactgtttaatgaacaaagagagaagtgacaatgagactgccctgtccagagactcccaaataaagaaggagtgggaaagtggaattagcaaagctcttgtaatcatagcaactcatttgagaagagctttggcaattatcaaagcaatccttcctgcattaagaagaaactgtttcctggatgtcactcgagtgactttctggcaagccccaagtcaacctattg

SEQ ID NO: 265474 - DNA, 723 bp, Homo sapiens
tgtttttcagatgggctgtgggagggagctgctttctaattcatcaggtcctaaagggactttcacgtgagagaactaatccaaactcagtgatggtgcaagggtacttcttacctctagggacagtctcgggtatgtcttcatcagcagcatgaaaaaggactaatacacccagctacaaactatcccttaagctaaatatgactggcttgaatggagcaactgtagaagtaatcagaatccccaagtgagtggaacaagtcagttctaaaagggagaaaaaccttgggaatgctggaaacagacagctcaatgggcatattcagaagaaaacaatagataccagtcttttccaaagtgtggtgtgaagagtactgctcctgtaaatttaacgaaattttccatgggcaagaaaaaagttctaggaactcctgagaactgagaaatgactgtttaatgaacaaagagagaagtgacaatgagactgccctgtccagagactcccaaataaagaaggagaatatccatcaatagctgttcccctcatcaatggagtctgaataagtgcatttttgtggatcaaacaaaagctctcagaaggagaaactctggtagaaggaggtagtcatacctttatatttaccttgtaagcttttgcaactccgtggtgctacttcgacagcctcatcttctgttttccaacatgaaattattcctgtgagg

SEQ ID NO: 265475 - DNA, 454 bp, Homo sapiens
agttgttatggcctctctatacagtagacatccaattctttgttaactggaaaaaagtttcagaagtttaaatttgaagtaacaggaattggtccaaaatatttgttgttgctcatgttttaaataagcgacattggattatatcagcactgggataattcccattaggtattatgactgcaatttacatgcaattggaaattagtgattgagagggaaacagattgccaaattatcttccaaaaaggtactccccactccatatccttgctaataacaagtattataattatttaaagtcattgccaacttgataggcaaaatattgtcttgttctaatgttcatttcttctattgtgaaggcgaactttttttttccatgtttcttgatcctatctgttgatgagggctggaagttcaagaaagtataaatttaaattattttaacctgaaa

SEQ ID NO: 265476 - DNA, 333 bp, Homo sapiens
gaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattc

SEQ ID NO: 265477 - DNA, 425 bp, Homo sapiens
gaatgctcctgtctagtttttatgtgaagacatacccgtttccagcgaaggcctcaaagctgtccgaatatccacttgcaaattctacaaaaagagtgtttccaatctgctctatcaaaagaaaatttcaactctgtgagctgaatgcacacatcacaaataagtttctgagaatgcttctgtctagttttatgtgaagatattcccgtttccaacgaaatcctcaatgctgccctaatatccacttgtaaattcaacaagaagagtgtttcaaaactgctgtatcaaaggaaagttttaactgtgagttgagtacacccatcacaaagtagtttgtgagaatgcttctgtctactttttattattattattattctttaagttttagggttcatgtgcacattgtgcaggttagttacatatgt

SEQ ID NO: 265478 - DNA, 420 bp, Homo sapiens
ttggccaggtatggtggtgggcgcctgtaatcccagctactcaggaggctgaggcaggagaatcgcttgaacccgggtggtagaggttgcagtgagctgagatcaggccattgcactccagcctgggcaacagagcgagactctgtctcaaaaataaataaattaattaattaaaaaaaaatagccaggtgtggtggtggcacatgcctgtaatcccagctactcaggaggctgaagctgaaggatcgcttgaggccaggaattcaaggttacagtgagctatgatcatgccactgtactacaggctgggtgacagagcaagaccctgtctccaaaaaaataaaataaaaatttttttaattgctatttctgaaaactacattggatgctttagaaagactcaataaaggtgacttgatt

SEQ ID NO: 265479 - DNA, 404 bp, Homo sapiens
tataaatacatcattctgatttctgcctctgtcttcacctagctatcctctctgtgtgtctgtcaaaatttccctcttcttataaaacacataagtcatattggattaaggcccaccttgatgacctcaccttaactaattgtaactgcaaagactatttgcaaataaggttccattcataaggtttggggtagacaaaacttgagaacagagactcattttcttctaaaatgctttctctgaaagatttttaaaaagaaaagggtggaaatttgaaagaaaaataagtctcaggaccccaaaatcagtaagccaaagggaaaagtcaagctgggaactgtgttaggcaaacttgcctcccattttattcccaaataagatagccacaaagatttaaaaaaaaa

SEQ ID NO: 265480 - DNA, 424 bp, Homo sapiens
caattttcattcaaataatattttaacacttcaaatatggtgtaagaatattacaaaaccccattactttcatatctccctggtttttaggcaattattatcataaccttcactcctgcattagctataaacctcatactacattctaataattttaacagtcattttacttgtggattaaattataaatttaaaaatgtacttttacatttaaccatatatttataatttcagtgctcttcaattaattatttatgtatgtattttcatctagtatctttttttcatattgaagacttttcttcaatgtttttcttagtgcaggtctcctagcaataaaaaaattcttatctactttttcttgtatttttgtctaaattgttttcatcttgacttatattttaataaattttttgctgtatat

SEQ ID NO: 265481 - DNA, 174 bp, Homo sapiens
attactgccaggcgggaatgtggactcagtgttgctccatcttctgattttttaagagaaactggaaaactagatttccatgtaaaacatcttaattttcaaatgttggctcagttttcttctttaaattctatacgtgccaaataaaacatattttcaggctagctttggcca

SEQ ID NO: 265482 - DNA, 224 bp, Homo sapiens
actaaacatttttatcttttttatttgtctatcattagacacatgaggtcacaattttctgtatgccataaatatagtaggcaatatctttcgcagaaaatggttttcatttcaatttttcaaatattaatgatatctgacaaaattttggcacagtttagaaacactttctgaacaaaaggagatgatacacatcatagctattgagtatgagtttccatgta

SEQ ID NO: 265483 - DNA, 152 bp, Homo sapiens
tccatattttttgtagagactcggttttgccgtgctgctcaggctggtctctaactcaagtgatccgcctgcctcagcctccaaaattgttggattacaggcatgagccacttgaaccagccagcaccaaactcttctgtagcagctgcccc

SEQ ID NO: 265484 - DNA, 295 bp, Homo sapiens
gcagtggaaagtggcccagagcgtggtcgtgaggggaaggttaggagggacgtgttcgggatgccagtggccagcgtgaactgactgcctgccggtgggcccactgcctgccgaccacaggagaaatgccctgtgtgcctgacccgcttctgactcctggttcctgggccctagcagtagtggcaggaggcctctctggggcatgaagcctgcgcctgtctcctgtgccatcgcgccaggtcactgcagctgtggagcccgcctgcccgccctggccttctcgtccgtgactgct

SEQ ID NO: 265485 - DNA, 409 bp, Homo sapiens
gtatctgttttgctctcctggtattgctcctattttagtggtaattcctgctcagctgctttgtctggttcttactcatttacctaacatgaaaaagctagagtacctcaaggctgagtgcagtttcactatgggaaacctgtaagccccataaattgcaaaatgataaaaaatatagtaagtaaagaagaatgaatcttgtaaagaatacctcacttgtgtccatctttcatcaatcatcacacactatgaagtgttcctctgttggcaaatacaaaaaaaaaatttttttatgtgtaaactatatatttatttaaaatgtttttattatcaagcatatataatttttatatgtgaaaattgttttgttatttggtttgtcatgaaataaatattttctcaccaatat

SEQ ID NO: 265486 - DNA, 167 bp, Homo sapiens
actttgctactccaaggtagaaaacataccttaaaaatacttatgttagaacttaggtggaagtgatttttagtccttttatatttatacacggaaaaaaaaacctgtgataatttattaggatggtttaaagtctcctgcaggtatagttttagaagaaaaaaaat

SEQ ID NO: 265487 - DNA, 165 bp, Homo sapiens
aatatgttaaaaaaaatctccacaaaatgaaaacccattacagtatattttgctattacagctaaaaaaaaaccccaggtaacaaaggaactaattctgtgagaaataaagcattcatttaggctgcagttgtcactggttttggaaaaagacaagttggatgtt

SEQ ID NO: 265488 - DNA, 845 bp, Homo sapiens
agataaggatacagggctcgaagaacgaaggtgacctgcccaaagtgtccaaagccacacatacaaagcaacaaattagggttttaagctagcactgttagacttcaaagcctcttaaccattctactgccctgctgtagggcatggggagatggggggataagccatggttgccatcaaagagttaatataacaataacatgcagatggatggcagctcctgtttattggcaccagctgtggtccaggtacagcgctaagcactataattacactgttaagtcatcagaacagaagctccccacaccagctctaataggggtgagtgttggacataagcagggagctgagaagaagccaagacaaggccggttgcagtgactcatgcttgtaatcccagcactttgggaggctgaggtaggtggaccacctgaggcaggagttcaagaccaccccggccaatatggcaaaaccctgtctctactaaaaattacaaaaattagctgggggtggtgatgcacgcctgtaatcccagttactcaggaagctgagggagggagaattgcttgaacctgggaggcggagcttgcagtgagcttataatgggccactgcacactagcctgggcaacagagcgagattccatctcaaaaaaaaaaaagccaacactagagatccttccactgctgggctctcaaagtctggattccaagcacctccaggtttctatttgggcatatttacataatttcgcattcgatgcttataatttttttatataacaagaaaattttatgcatctcaaatgtgtacattttttttttcagacagggtcttgatctgtc

SEQ ID NO: 265489 - DNA, 1949 bp, Homo sapiens
  misc_feature (836)..(836): n is a, c, g, or t
agttgggagagcgtctgtagcttccttgtgtccggccgtcagctgcagcccggggagccaggtgcagaaacggaagatgaccactctgtgactgaagggcctgcggatgagggcattcgaccacggccgcaggggtcttcacctgtctacgaatacacgactgaggctgccgactttggactccaggaagacgcccccggcaggcaaggttctgctgggagacggagatcctggtggaagcgagattcaggggactcacggacatttttcaggatgagtcgtccagaggctgtccaggaggcaacagaggtgacgctgaagacagaggtggaggcaggagccagtggctacagtgtcacaggtggtggggaccaggggatcttcgtcaagcaagtgctgaaggactcctcagccgccaagctttttaacttgagagaaggggatcagctgctcagtacaaccgtgttctttgaaaacataaaatatgaagatgctctcaaaatccttcaatattcagagccgtacaaggttcagttcaaaatcagacggcagctccctgccccacaggatgaaagagtgggcttccagcgatgcccagcacggcccacagggcaaggagaaggaggacacggatgttgctgatggggtgcagagagacccccacgaaaactctggaaggagatggggaccaagagagactcatctccaaacccagggtggggagaggcaggcagagccagagggagaggctctcttggccaaaatttcaatccataaagagcaagcgggggccgggaccccagaggtcacacagctcgtcagaggcctacgaaccnagggacgcacatgacgtgtcccctacaagcacagacacagaggcccagctcacggtggagcgccaagagcagaaggcagggccgggcagccagaggaggcggaagttcctcaacctcagattcaggacaggctcgggacagggcccttcatcgacaggacagccaggcagggggttccagagtggggtgggccgtgctggggtcctggaagagttggggccctggggtgatagcctcgaggagactggggctgccacaggcagcaggagagaggagagggcagaacaggatcgagaagtgatgcctgctcagagcatgccattgcccacagagctcggtgaccctagactttgcgagggaacccctcaggaagggggactcagggcagccaggctccatggaaagaccctggaggggcaggcacaggagacagcagtggcccagaggaagcccagggcccagccaactcctggaatgagccgggagggtgaaggcgagggactgcagagcctggaaatcgggatcgccagactgtccttgagagacacaaccgaaggaggcacacagattggcccaccagaaattagggtgcgagtacacgatttaaagacaccaaaatttgcattttccacagaaaaagagccagaaagagaaaggcgccttagtaccccacagcgagggaagagacaggatgcgtcctcaaaagcgggtactggcctgaagggtgaggaggtggaaggagccgggtggatgccgggcagggaaccaaccacacatgcagaagcacagggggatgaaggagatggagaggaaggactacagaggacaaggatcactgaggaacaggacaagggcagggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaagaagacagtgactcaatgacaaacacaacaaaaatacaactaatacacgatgaaaaacgcttaaaa

SEQ ID NO: 265490 - DNA, 432 bp, Homo sapiens
agtttcaagatgcccaaagtggacctcaagggcccccagatagatgttaagggccccaagctggacctgaaaggccccaaggcggaagtgacagcccccgatggcgaggtgtctctgcccagcatggaggtggatgtccaggcccagaaggccaagctggatggtgcgtggctggaggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaagaagacagtgactcaatgacaaacacaacaaaaatacaactaatacacgatgaaaaacgcttaaaa

SEQ ID NO: 265491 - DNA, 315 bp, Homo sapiens
ctcccgcccgcccgccccgtgcgccggagccgggaccagcgactggacgcgacgggccgccaggcccgcaccgcctggccgccgcgatgtgcgactgcttccacatggtgctgcccacctggcccggaacccccggcagcgtgtccggccgtcagctgcagcccggggagccaggtgcagaaacggaagatgaccactctgtgactgaagggcctgcggatgagggcattcgaccacggccgcaggggtcttcacctgtctacgaatacacgactgaggctgccgactttggactccaggtgagcctgctgggca

SEQ ID NO: 265492 - DNA, 963 bp, Homo sapiens
ctcttcgtgggcacattgcgtggcccttcgtgtggcacgtggagaacacctcctactggctgcagccatccctgcagcccagcagtgtcatcagcatcatgaagcctgttcgaaagcgcaaaacagctacaatcacaacccgcacgtctagccaggtgactttccccaatgagccggctcgttgcgtggctccttggcacattgtgggatcgctttgaggtacaagggctgcagcctaatggtgaggagatgaccctcaaacagttcctcgactattttaagacagagcacaaagagccggctctttgcgtggcccttcgtgtggctcgtcgtgtggctcatggggtggctcatagcgtggcgcatcgtggggctcttggtgtgtccttgagagacacaaccgaaggaggcacacagattggcccaccagaaattagggtgcgagtacacgatttaaagacaccaaaatttgcattttccacagaaaaagagccagaaagagaaaggcgccttagtaccccacagcgagggaagagacaggatgcgtcctcaaaagcgggtactggcctgaagggtgaggaggtggaaggagccgggtggatgccgggcagggaaccaaccacacatgcagaagcacagggggatgaaggagatggagaggaaggactacagaggacaaggatcactgaggaacaggacaagggcagggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaagaagacagtgactcaatgacaaacacaacaaaaatacaactaatacacgatgaaaaacgcttaaaa

SEQ ID NO: 265493 - DNA, 641 bp, Homo sapiens
cctttattcctagaagctggcaggctttcttttcctcctacaagtggtaacccgaattctgagttgaaagtgaatctttgcccttggctcctctccagcattcctcactgagcgaatagggatttggaatgtcagaaaatagaagaggggaggggaaaagatgtgtgtatgactgtgagtgtttatatgtaaaagcagcttcgtctgggaggacttagggaaacttgacttcctcagactgcttccttcttataaactcttggttccttatttatcatttttcgtttttgttttttaagttgtttgacctgattttatcatagtagttccaaatgccttacagcccagtggagtcaagctaaggaaagacagcatgatttccacaggatttgtatttcttccctctggataaagtgatagtagttcccagactcgctgccggcaggatccaaggtcgtctttcctccgggatttaatctggtgtcatcaggaacctagactcaggttttattggagagcaaggctcaataagaagtgtcctttgaggagaatcaaggactcaatctaggcataaaaggtgttgctcagcacaataccctctacggtaagctaccagtcctgagaacctgtggtcaaagctg

SEQ ID NO: 265494 - DNA, 1127 bp, Homo sapiens
ccttcttgaaacacttatgtgtctgtccattgtaaggcattagtactttcacattatatatcagatgagctatcagagaagacaattcttaggaaacagggcacaaaatataaagttttaattggtttggagaataagagtcttttaagatatgtagaaacaggatgattgacaaggggattttgtgttcgtcatcacattatgatgttaggtttgcaatgcgggtagttagaaaacagttttcattgaggtccttagctggcaatgtactgtgcttcccttttggatagttagtacttatcaccacgtggcctaaaccaccaactggcctcttacataaggaatacttacagagatagggtggtgtactccctgactcagttttgctttttacataaaaacataaaaatagaacatgttgttaaatcccaggtgtaactaaattaattcgtgctgatttatcttgtaacctggaattttctctcttcatggctttttttttccttatctttggacaagtttctgacaaaagttatgctgtttgctttcttttagcctttttttcccaaatgggatggggtggtatattagagtcccctggaagtttttcctaaagtacacaatgctctgatgccttccgggacctactgtgctagttctttgtggagagggacttgggaatatgtactctgaagaaactccgagttggtttggcagtgcactgccttctcactgctccaggatgggagggtctgtattagacaaatatgcctaaattctaaacatcagagtcagaagaaccttaacttttattccaatatatgaattatctctattcgtgctggatgggtggctgtataaactatagccttttcttaaacattttcaacaccaggaaaatcacaaagtagcttaccccacttttggacggctcactagagagctttttgggccttgaataaaattctgccttgctgggatggcccccattagatttagttctcctctctgcagatggacatatataatctctatatcttgtgaggaattctaggaagaacaagtcagccatcaggtattccctaagtactcttttaattaaccctttaatgattattagtatatta

SEQ ID NO: 265495 - DNA, 792 bp, Homo sapiens
ataaagaaaaagaggtttaatggactcgcaatcatggcaggagacaaaggaaaagcgaagggacgtcttacacggcggcaggcaagagagcgtgtgcagggagctcccctttataaaaccgtcagatctcaggaaatgtattcactatccggagaacagaacaggaaagcctgccccatgattcagttacctcctgccgggtccctcccacgacatgggaattataggagctacaattcaagatgagatttggtgtgatattttgacatgtatatacaaagtataatgatccatcaaggtagttagcatatccatcacctcaaacatcatttcttttgtgttgggaacattcaaaatcctctcctctacctattagaaaatatgcagtaagttactgttaactgtagtcataaaatattaacaggcttgctaggacataggaccagaaaaaacatagaagtctatggttacaccaagattggagtcatatttttcagtaactaatgtattcaggaaaattgatgacaaggagaactagaatccgttaaaaaaaagactcaaattgaagaaagagcatcagtcttacacagagtcttccaaatgataaaggggaactcttcttaccaatttgttctacagggctaacaaatttgatactaaaactcgaaagggacatgatgggagaaaacacacatggtattctctctcatgaacattgtttaaaattccaaaccacatattagcaaatcagatccaatgataatgtaaaaaaggtaactcatcacaaccaag

SEQ ID NO: 265496 - DNA, 526 bp, Homo sapiens
acagtatcctatgaactatttcagtaaacagtgcaaggcaaaggaaaagaagattcaaagagcagaataaatctttaaaatgtgaacataagctctggccaactctgccttggtctgccaaggaggagcttagggcactgactgagacacagcacacggaccaggcacggatgtggccatcagggctctgccagcatctccagcagcgtcgctgagtggagagggaaggaagcttccagaactagaactagagaagaaggctggctggagtgacagagagaaagagagaaaaggctcagccaatcacagagttgcgaggcacctcggagaccctctggtcctccccgactgtgatgtggcacttgggggctctgtcaaggactgtccaggttcaaatcctggctccaccactcactagctgtgcactctctggtctcggtttcttaatctgtaacttgtggataaaaatagcatctgtcacataggacctatgtcagcataaaatgagataattcacatcaagtca

SEQ ID NO: 265497 - DNA, 572 bp, Homo sapiens
cgatgatctttggtgagcatgctatacagggccttgctttcagtaccaaaggcacaattttattgccattccctgtttacattgagaaaagtatcagagatggttttctctccaagctctcctgcctgaaacaccttctctgtcaatatcaccaaatattttagaaggcagagaggttttcatcaagggaagtgtgaagatcatgatgttcttttcttaatgaagtacaacttgataacctgctgatgttttatatttcctttttttctactgcttaaaaaaaaatctgtgggccaggtgtgggggcatacacctgtaatcccagcactttgggaggccaaggtgggaggatcacttgagcccaggagttcaagaccaccctggtcaacatggtgagaccctgtctctacaaaaaataaaagcattagccgggtgtggtggtgcatgcctgtggtcccaactattcaggaggctgagacaggagtgtcacttgaccccaggagtttgaggctgcagaactgtgatcacaccataggactccagcctaagcaacacagcaagaagcctgttta

SEQ ID NO: 265498 - DNA, 299 bp, Homo sapiens
  misc_feature (24)..(24): n is a, c, g, or t
  misc_feature (29)..(29): n is a, c, g, or t
  misc_feature (32)..(32): n is a, c, g, or t
gcggtcgctactactactaaattngcggncgngtcgaccttatacaaaagggtaatccaattggcattttgtcttttattaataaaagtcaatgttgaatcctataagaggttatctagagtttcacgaaatagaaaaaattaagataaaatcaagctgggcatggtggaacacacctgcagtcccagccacgcaggagcctgagcagggaggattactttagaccaggagttcaaagtcagcctgggcaatgttgaaacaggatctgtcgacgcggaccggaatttagtagtagttgt

SEQ ID NO: 265499 - DNA, 403 bp, Homo sapiens
cttaagggaagttaaataacttgatcatggtcacaccttaagtggttgaaaaggagttcctctcagatttctgtgagtctgaagcccttgtgatactatactgccaaagcattggggcccattttgtcttgttggtgagaagtgttaaagactgccattcaacatttagtgagctcttaatgcacctgtagcaccagtacccaaatgtaaaactagcggtggacgtcaaggaatctactgtgtaattaaggagacatatgtacatttgaaagagataaaaacactttttaaaaaaggaaacaggccaggcgtgagccatcatgcccggccaacttttttattattcactaattagaagtagactttctacttctaattggagaaacaggattgctgcttctca

SEQ ID NO: 265500 - DNA, 367 bp, Homo sapiens
tcacttattccaggaaagcaacctttgttgggacagaataaaaactgcaatgaaactaatttcagagatccagtgtgtcaaagagttctctggcagagacaggtaattagaattcctggaaaccattcacagcttcctaggactattttttaaaaatacctacctttacctaaaaatggggatcatttgcttaacattctccataagcaacttgcaaggactgaaaatattagcaaagacttaactatatcagttaaaactacatttctcctagcaatgtagatgttattcttaatgttatttctttctgggtctggcctttttttttgctttaaaaagagagtatatagtactacaggtgcttatg

SEQ ID NO: 265501 - DNA, 293 bp, Homo sapiens
cacagtgggacactgagagctagagcatctcgatgtaggacatcatgacttaatagagtgggacagtgagagctacagcagcatctcgatgtagtacaccatgacttaacacagtgggacactgagagctagagcatctcgatgtagtacaccatgacaacacagcgggacactgaaagctacagcatctcgatgtagttcaccatgacttaacacagcgggacactgaaagctacagcatctcgatgtagtacaccatgacagcacagcgggacactgaaagcttcagcatc

SEQ ID NO: 265502 - DNA, 631 bp, Homo sapiens
ttagagttcagaaaggatgtgcacagttggctcagagccagtgctggcaaaccattgcatttactccacccaagagtggattttcacataatttctaaaataattttttcttatttatatactgacttttcaaaatacaaaattaaaatatcatgtctgacttcagtgatctttttctttttctttttttagaaatgagatctttcagtaatcctttaatttaattttttagagatggagtcttggtgtgttacccagggtggactcaaactcccgggctcaagtgatcctcctgcctcagcctcctgcatagctgggctacaggcatgcaccaccacacctggcttagtaatccttctttattaatggtttgtcacagtacgtttgtgatgttatattgctcatggcatactttatgtgttcgaacaaaggtggaaatttccattgatttttttttttttaaatgtatgcacaaacaatctggattttgaggagtacggtcaggaaaaaaaaaaaagaattagaggcccttgaaaggtcaaccgtaagcttcttagagttaaaatatgagtttaattttttcccacattttgacagttgaaattttgatagggacagtaaacctatgagc

SEQ ID NO: 265503 - DNA, 630 bp, Homo sapiens
ttagagttcagaaaggatgtgcacagttggctcagagccagtgctggcaaaccattgcatttactccacccaagagtggattttcacataatttctaaaataattttttcatagctttaccatatgttgtaacaggaaaaaaatggtgtctatgaatttcttcttaatttaacaaatttgtctttttttagaaatcacatctttcagtaatcctttaatttaattatgtacaggattgagattaatactgtagtataaattgggacattataacagattccatattttatttcctaacatcctcctgcatagctgggctacaggcatgcaccaccacacctggcttagtaatccttctttattaatggtttgtcacagtacgtttgtgatgttatattgctcatggcatactttatgtgttcgaacaaaggtggaaatttccattgatttttttttttttaaatgtatgcacaaacaatctggattttgaggagtacggtcaggaaaaaaaaaaaagaattagaggcccttgaaaggtcaaccgtaagcttcttagagttaaaatatgagtttaattttttcccacattttgacagttgaaattttgatagggacagtaaacctatgagc

SEQ ID NO: 265504 - DNA, 506 bp, Homo sapiens
gataaaatgaaaattaaaaacagcaagtgtcaaccctgaccagaatcctaatctggaaagaatgagggtgtgcgtggtgcgctccacagctactatgtgcaagacattcaaaaataatggaatatggatccctcaaagttgttgtatttcagagattatttactgtatgttgtgggttatgaataatgaattcagctttcaatatttcataatcctctcctactctgtattatgtacaaatattgaacagcaagagattctaattataaatttatggatttcttgctgtagaaaaatttatgtctaaattgaagcttttcataagatgtattagttgacaggtatcagtgttcaaacagccttagaatgatgcctaattacatctacaagggagtgattgtattccacaaagaaatgatgtgctagcatcagatccttcagaagtagagctcgaatggtaaaagattttctgtgaattgaaactaacattacataacaataaccat

SEQ ID NO: 265505 - DNA, 299 bp, Homo sapiens
ctcacaccgagggaaacgtccctcctgttttctgcttcccatcgagcttgtcctgattgtgccctctgtggtgcttttccccttgcgtccgtactatctgggcggagcacgtgtgtccagggctttgtgtcctgtggtgataagagcactggctggggcatctgtgccactgtgactctccatgcctgacccagctagaaccctgcaggagaactgcctctgcttccttcgtgcctggtgccaccacctgcctagaaacgggcaagggtggcttgggctgtgagctgctgctactctca

SEQ ID NO: 265506 - DNA, 362 bp, Homo sapiens
gaaagctgtggccacaaaggtcactccatggactctgagcaggggccacaggggcttctggatggagacctgggatttggccacacattgcatccccagactttgctggatattcccaaccgctctgagtgaattccagggaggcatcccctgaagcaggagtcccaccccgctgacatgcttgacaattcaccacaaacccaagtacaggtgacccaggagaagaaggctgccgagcgaatgtcctgcatgcatttaaagagttaataagggagggccaaggagcctgatttaaaacagaataggaaagtcttttaaaatatctttttttaaaaaaagtaaaatacctttaaaaatcttta

SEQ ID NO: 265507 - DNA, 414 bp, Homo sapiens
gtggtaggtcaagtgtggccaccattggggagacgagaaagaagtggggccccaccagattgcacaatgggaacctcagctggcccctgaacagaggactcagttgtctccaccctacaccgctattccctggagctcagccaggcgcagccttggaaggagaaagggctggggttacctggcttgtcctcctccaggaaagcccccttcctcctctgccccagctcccagcctggcctcctccaggcaggccctactcctctgccccagctccggctttccccatgaggtttgtcccaggcatgaagaaagcatccagggtgccaatgagtgggcctaggcagaggcccctcagtccccaagggtactgttttggtggcctttcagagggtcaaggaagccctgcttggggta

SEQ ID NO: 265508 - DNA, 890 bp, Homo sapiens
ctcagcctccagagtagctgggactacgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcagttacctggggaagagtaaaggcaagaattcttaccagcattagtcatacatcctcctgataggaatctgcgaaaacacacacttctgcttttagttctattcttagaattctctcctgggctgttgctcctttgttccttcattgtaataaaaatggattctgaaagcaaaaaaaagaacaacaccagtattataagaaagagatagcagccattcaccacccacaaatggcatgggggcgaacacaaatgaggcaccaaacaacagaggaaagactcataaccacattaggggagcgccaaaacgggggacacactgcg

SEQ ID NO: 265509 - DNA, 337 bp, Homo sapiens
atagtcagattaaatgtcaaagaaggcatgcaggcaaaggggtaaagaatccctttggaggcctggcacagtggctcatgcctgtaatcccagcactttgggaagccgaggcggacagatcacttgacgccagttcaagaccagcctggccaacatggcgaaaccccatctctactaaaagtacaaaaattacccaggcatggtggcacatgcctgtaatcccagctcttcgggaggctaaggcacaagaatcgcttgagcctgggagctggaggttgcaatgagctgagatcaagccattgcactccagcctgagagagagtgagactctgtctca

SEQ ID NO: 265510 - DNA, 513 bp, Homo sapiens
tggaatatgcataactttccaatgttggaaagtgatctttgctatgctgatcattgattgattacctgacagtcaacacctatttgaatcactgtctcttgcctctaagcattggcttccaagtagatttcactgggctttgtattttaaagtttcctattttccaagctctgttatttgccatgcttcttttcagttttcttaggaaaaaaatgattggatcctgggggcatttgctagatatctggcaaggagcatcacacaggtataaaagcaagtcaacctaactgaggaaaattgagtaaaatggaaaaggatgccagtagaaaggagagaatctgggaggaaaaaaaaaagggaaactatatacagtcaggtagtagtcatatcaaaaaacaaaggaatgcccccaaagagttatgaattgctgcaggagaattaatgagatggaaaatttctcaaggaaaaagagccaagtatatataaaggggagaaaagcataaaatgaagaaa

SEQ ID NO: 265511 - DNA, 537 bp, Homo sapiens
agaaggcatcatttggcccactgcacgtcctggcctattcaccaaagcccttcctggctctgactgccacaccaggcagtgggtgaaatgctggctttttccttaagaaattgtgttctagtgccaccaagagatgctgtagagctggctttaccaatctcatgatgcttgcttggcaactctgaaaggtgactttggccaagaagaccttgtggcaattctgcaaattttatacactcatatcttttagggtacaaaatgaaagaacaaatcacaaagaacaatagatccttcaggagctgaaggtaagaatcttttatagctattttaacatatacagtgactactttctactagccaaatatcaaattttacaactaccaccaagccacagattataggtggtaacaactccagaaatgtcctaactaggaaaggtgctcatctagtatgcatcggtatccaggataatatgagttagaattttaaaaatgtcagtcattcaaaaatatttgaactgtgacatcacagaagtaa

SEQ ID NO: 265512 - DNA, 342 bp, Homo sapiens
aattgcactagtaaagtatatctaaagaagttgtaatctgaacattctgaaacaaatttacctgtagctcagtaaaataccttagtttccagatttctatttttatttaatttttgttattattattattattattattattattattattttgagaaagaggctcaccctgtcatccgggctggagtgcagtggcacgatctcagctcactgcaacctctgcctcctggttcaagcaattctcatgcctcactacttggaaggctctgaggtgggaggatctcttgggcataggagtttgaggccagcctgggcaacatagtgagacccccaactcttaaa

SEQ ID NO: 265513 - DNA, 212 bp, Homo sapiens
agggcctgggggtggcctgggcacatgctgagggttctctcctgcaggacagccacagtgtggaagaccctgtgccccttctggggtgaggagtaccaagtgcacctgccgcccaccttccacgctgtggctttctacgtcatggatgaggatgccctcagccgggacgacgttatcggaaaggtctgccttacaagggacaccatagcttc

SEQ ID NO: 265514 - DNA, 402 bp, Homo sapiens
tccccccttacccacattgttgttttctgaggtcaattacctgcaaccttggccagagatattaaatggaaaataaagagaaataaacagaaacaagcaattcataagttttaaattgtcactgggcatagtggctcatgcctgtaatcctagcactttgggaggctgaggcaggcagatcacgaggtcaagagattgagaccattctggccaacagagtgaaacaccatctctactgaaaatacaaaaattagctgggcatggtggcatgtgcctgtagtcccagctactcaggaggctgaggcaggagaatcccttgaacctgagattcggcggttccagtgagctgagatcccaccactgcactccagtctggcgacagaaggagattctgtctcaaaa

SEQ ID NO: 265515 - DNA, 946 bp, Homo sapiens
agcgggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgatcaccagcatctacttgccccctcgttccttccccagccctttagagaagggaccatgatttggaaacgcagcgccgttctccgcttctacagtgtctgcgggctcctgctacaaggtcgccttttcttttccccctcttcccaccatcatcatatccgtgtgtctttaaaaagtgtgtgagagcctgggagcgagctaccaagacgggcgagaacagcagcagcgacagcaccgtgtgcattgcaataacatccccgggggggaaatgtgttctgagacgtgtcatttacctaggaagagagaggggactctgtctgggatttaaaaaaaaagaaaagaaaagaaaaagaaaggaaaaagaataagaaa

SEQ ID NO: 265516 - DNA, 753 bp, Homo sapiens
agcgggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgatcaccagcatctacttgccccctcgttccttccccagccctttagagaagggaccatgatttggaaacgcagcgccgttctccgcttctacagtgtctgcgggctcctgctacaagcggttgcttcaaagaattaaagttcaaggcagccaagggcagtttcactaaacacagaatg

SEQ ID NO: 265517 - DNA, 237 bp, Homo sapiens
gaataactagaaagacctttaaaaaagaaaagaattaggaaaaacattaaaatgtacttgtatcctctataattaaaaccatgtggtagtgatgcacagatggacagacacagcaatgaaacagaccagaaagtccagaaataaactgaagcacatatgataaaggcagcatgttaatcacagaggggaaagatggactttttaatagtgttggaacagctagacagccatttgtta

SEQ ID NO: 265518 - DNA, 431 bp, Homo sapiens
ccatgttagatgaattcctactcctccaactacagtaggatggggctaattaattactgccttcattcaataaatatttatcgagcagctgctgttgggctgacactgtgcaagctatgtaggctctgaggatgcagagagagggatcctgcttctacttttaaggagctgtcagtctggtcaggggaatattacaagtaaagggagagcttcagattattttggtaagtgcttccataggggtaagcacagggcgtaggaggaatgaaaatgagggaaaggaacccaagctgagatttgttttctgtgggaggtggagaatagatctcaaagcaggtgaagcttagagcattttgaagaatgagttaaagttggaaatgagagtatgggagcagagacatcctgggcatagaaacgtgaggatctgaaaa

SEQ ID NO: 265519 - DNA, 279 bp, Homo sapiens
aggtaccacccacccctccccgccaggaaatattttctacatttggtgaaacttcataatacaattaatttaaatattttcatatattctaccaaatcatttcatgagtacagacttgctgttaaagtaggtatctgtttaatcgtgcactgtctttcttctcctgggaggaacagacccttccacacttcaggaagcctcaaggaaggtcagtgatgctgacctcgggcagaagtttgaaggagtaaacaaagcagaatgaaatgaacttacaaaaaa

SEQ ID NO: 265520 - DNA, 832 bp, Homo sapiens
gatggtatggtggaattaccaaggggcacatggaaaccattgagggtgatggataaattcataacattgattaaggtggtgatttcattgttggattcaattgtttaaacttattaaatttagatttcaaatatgtgcagtttattttacgttaaacacatcttaatgaagccgttaagaccttttgaagaggatgatggttgggtgcagtggctcacacctgtaatcccagcactttgggaggctgaggcaggtggaacacttcaggtcaggagttcgagaccagcctggccaacatggtgaaaccccatctctactgaaaaatacaaaaattagccaggtgtggcggtgtgtacctgtagtcccagctacactggaggctgaggcgggagaatcacttgaacccgggaggcggaggctgcagtgagttgagatcaccccactgcactccagcctgggtgacaaaatgagactgtctcaaaaaaacaaaacaaaaccaaaaaaatgagcaaatcaaacccaaagtaagtacagaagcataataatatgtataagagcagaaaacagtaagtggaaaatggataagtagtagagaaaatgaacaaaacctaaagctgttttttaaaaagattaataaaactgataattattttgctagtgtgaaaaacaagaacagaagagaaaacacaagttattcatattgggaatgaaagaagcgcctacgtacattacatggactataaggtgatattaagaacaaacttatgctggtaaatttacatgaaactctaaaaggttagaaaaattattttaaaggtacaagttaccacat

SEQ ID NO: 265521 - DNA, 474 bp, Homo sapiens
ggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaacacatctgtcggcattttgcacacttatgtattattatgatacaacatattactttatggtaatttttatttttacatataactacctccataaatttgatgaaatggcagccgtgt

SEQ ID NO: 265522 - DNA, 388 bp, Homo sapiens
taagaacaattcctagaaaagttatccatgtagtcagtctgttttaaacaaatccagtgtatgaaaatcatgttataaggtaaattggaaacgtttatttcctttaactctttaaatgtgtcacactttttgctttctatttttaaactttgtgtctcctacaaaataataatcaaaaacaaaaaaagtaagcataacccgtagtttctttccaaatgcctttaaagtttcaaagcagtaattacaccttgcggcactacccggttcggccggtgcctggctggagggcgccggagagcctggagcagggcgccggagagcctggagcagggcccaggaggccggagcaggaggagaaggagtaggaggaagtggtcactagcgcggc

SEQ ID NO: 265523 - DNA, 395 bp, Homo sapiens
ttctgcacagagaagccccggggtcggtcaggaggcagaaggaacaaggggaaaatgtaggcaagagtttttattgtgattttcattggaaagaacagccaaggtagggtaagtaggcctagaactggcttgttcgaataacttcaacaggctcctaagaagctgtccttaggtgtctggtaccggggcctggggtcattagggcaggcggatagtgacctcagcttaggagaggcttggttagcatagatagttgtggttatgggctctggatgggttactttgcataagaaaggcgtgctctaggttaagttgtttactatctttaggaattagctagcgagggagagacagtccctgcaggatcagtaaggccccaagttgtcaaaacatcg

SEQ ID NO: 265524 - DNA, 527 bp, Homo sapiens
acatcatcctacctcagaaactggataaacaaatgcccaaatgagagaaacagaaaccacagctcctagaaaaaactcttgaaccataagaagactgtaaaagaaaggggctgaattctgaccataggaggagtcacgcaaaaatctccctttatgtggttcccagtgagcttgtctgaaagggaaatgagtggtgaaaggcttttagttttaaatttttgtcaaaaggatgatctattctgttgcattatggcccatgcagaaaagaaggaaaatcaaagtaatgctgaggaggccacttcaaggggggaaaaagaataactttcagttagtattttcgtttgtttcaaaaatagacaacatttggcataaggtcacttgtatatcactgaggatgatagatgatgtggagatataaagtatgaaaatgaaaatagttatttaaaaaagcttaataatgtgggggacatgtttagaaaactctaagttggtatcttcctacccttttcatatcatggttcatatta

SEQ ID NO: 265525 - DNA, 397 bp, Homo sapiens
agaggtgagggcagtaacaaagcagactaggaagctccaggcccttttttgcctcatagaaacagcaagattctacctacagaaacaacagatggactgaaatagcttcatgggaggtctagaaaccagccaaggatctgcagaaaaccaaacaaatgcccccagtcatgaaaaagccatactcaattcccacttacacaggcaggggaacaacacacactggggccagtctgacgggtcaggggccatgggagggagagcattaggacaaatagctaatgcatgcggggtttaaaacctagatgaccagttgataggtgcagaaaaccaccatgacacgcatatacctacataacaaacctacatgttctgcacttgtatcccggaacttaaagta

SEQ ID NO: 265526 - DNA, 289 bp, Homo sapiens
ctcctgaaaacaaatgatgctaatggctctccttttacaagacagggcagcattaaagaaacaaaaataatcagttccagaagctacagggaaccagaaagctgaaaaaggagcagaacagggaagtgcaacaaccccctcctgactccaagactcgagctgcagtgctcccaacaccagaccaaggcctcagtctccctcccactctctgccttacctggtatctatgactcgactgaaattttacaaacagacattatttgtcaatcatacctcagtaaagctggaa

SEQ ID NO: 265527 - DNA, 438 bp, Homo sapiens
ggctgaaattttccataataactgtagataactcaacatgtttaagtagattttagtttggtatttgattaaaagttcataaaatggaacaagaggaaattagttattagcaagaatgttgaagaaaagttggaattaaaaaaaaatctcaggcgggtgcagtggctcacgcctgtaatcccagcactttgggagtctgaggtgggtggatcacctgaggtcaggagttcaagaccagcctgaccaatatggtggaacccccatctctactaaaattataaaaattaccttggtgtggtggtatgcacatgtagtcccagctacttgggaggctgaggcaggagaatcgcttgaacccgggaggcggaggttgcaatgagctgagatcgcgccactgcactccagcctgggcgacagagcaagactcctctcagaaaa

SEQ ID NO: 265528 - DNA, 302 bp, Homo sapiens
atgcgcagtgaatggtcaggccctccgtgagtgaattacagattcattgaagagccgtcagatgactggagcagtctggtttcttccctttttatcgagttctgtcattgtgttcctcaaactgtggtttgttccagaaaggaagaggttgtcttcttcacccgcctgccctaagttgcgtcaagttccagttccctgtattaagtaaattactaaatgagtggaatgaacatcataatgtcaagggtagggcgttgacattatgggacaatagaccacgagcccactctgtcagctttttg

SEQ ID NO: 265529 - DNA, 350 bp, Homo sapiens
atccaacaggcctgacatcatcatttctcaccagtgtaaccttggctcatgaattctgctttctgagcctcagtttcctcatctgcagaatgggggcagcacagagcctccctcattgccttgttgtgagcgttccccaggatcatgagtgctttaaaaggtgcttaggtcagctgagcacaatggttcacacctgcaatcccaacactttgaaggctgagacggaaggaagatcgcttgagcccaggcgttcaagaccagcctgagcaacatagtgagatcccatctctatttatatatttgaagtgcttaggtggtagttcctcaataaattaaacagaattaccata

SEQ ID NO: 265530 - DNA, 495 bp, Homo sapiens
ccctgttacgtgtcacagagacctgggaaaaatgcccagcgatagggaactgggcacacctactatagtatgtgcaaataagccaacgttgaggctggaaggacattagagagcatgtactctaacgtcttactttcttaatgtaggtaccatggtgcaggcagaagtgactttcgaactgatgatgggaaggtaattagcaccaactctgggagccttttttcttcaatagtaagatgaaagccaggtgtggtagctcacacctgtaatcccagcactttgggaagccaagatgggaggatcccttcagcctaagagttggagaccagcctaggcaaagaagtgagaagctgtatctatcaaaaataaaaaaaaaatagctgggtctgatgttgggcgcctgtagtctcagctacttgtgaggctgagaaaggaggattgcttgagcccaaaaggccaaggctgcagtgagctgaggtggcgccactgtgtgcc

SEQ ID NO: 265531 - DNA, 263 bp, Homo sapiens
catctgttctctctcagggctgctacctgtgaggtttcatctgtagaacaaggccacctttgctagccaggcctcctctgctctccctcctgtaaccggtcttgccactgtcacctgattttccaccataaactgtggccatactttgagcccatgttctttctgtaacctcaagatggtgtataagcttccgaaccccattgggaggttggggtcatcactctggttctccctgtgtgcatgaataaatctgtatgcctttt

SEQ ID NO: 265532 - DNA, 422 bp, Homo sapiens
cttgcttcctccaggacttgggaccctggaggactgacgctgctggcctgggcgtccccttccgctgagccatggcgactcccgacgtgagtgtgcacatggaggaggtggtggttgtgacaactccgtccaccgtcctgggcaagggttcccttcaggcgccccccgccagctccccagcctccccgctgctcgggggcatacacagtcttggcctcttccggctccacctaccccagcacagtggagatccacccggacgcgtccagcctcacggtcctgagcacggccgccgtcgaggacggtagcacggtgttcaaggtggtcagcccgctgcagctgctcacgttgcctggcctgggcccaccctgcagaacgtggcccaggctcgcctgctccagcacaattgtgacagtgcccgc

SEQ ID NO: 265533 - DNA, 409 bp, Homo sapiens
tacaaactcattgatccccttcccagtgccagcacttcgtatcttattcatgtgaccacaaattaaggatgtgattttatagcagatgtgaaaaggagagaaaaatctattcttactttactatcttcatttaagagctacatttaatgaggattaaactgaaggggaagctaattttgcaaaatgtcttttgcgctcctatttcctgcgcctcattctactcattgccaccctccattccctcctctgcccacacacgggttagatcaccccatcatggaactgatatagattaaggctagcctgtgtggccagcttagagaaaagttagtggtatttccaaactccgggacccattaaggtttggtttgtttgtttgtttgtttatgaaggaatagccttgagcacc

SEQ ID NO: 265534 - DNA, 383 bp, Homo sapiens
accacagtgccctttcctggaggtctgaatggtacttccgaggctgtcactcttcctttctttcctgcactttcctctttgttggccaatccactcttccagtttttatctttgtaacattccgagtggttttattactaggaatctaagaagcaagatgactacacgtggtgttgtctgtacaggaaccgagctgtgcatgcggagggaagggccctgcagattctgaagggagtggtgtggttggtcaccgatcgccacgtgctcctggtgttcatgtagaggctggtgggcagaggtgctaggagcgacgtgtgcactttgaaggcacagtgataactggagtttgaactgttatgtaaataaactgtgagcattcagtg

SEQ ID NO: 265535 - DNA, 3034 bp, Homo sapiens
cacgtgctgtcagaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcttcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaag

SEQ ID NO: 265536 - DNA, 3008 bp, Homo sapiens
atatcgtcgacccacgcctcgccacgcgtcggccacgcgtcgccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcttcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaag

SEQ ID NO: 265537 - DNA, 2980 bp, Homo sapiens
cacgtgctgtcagaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaatgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcttcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaag

SEQ ID NO: 265538 - DNA, 406 bp, Homo sapiens
agagggtttctagtggggcctggcgttcattttcaccaatactctttctgtctccacaataaggatatagagaatagcctgagaacctaaccattaggtgttgaaatgtttttatagaagaatgttggccaggcgtagtggctcacgcctgtaatcccagcactttgggaggccaaggtgggcagatcacgaggtcaggagatagagaccatcctggctaacatggtgaaaccccatctctactaaaaatacaaaaaattagccaggcatggtggcgggagcctgtagtcccagctacttgggaggctgaggcaggagaatggcatgaaccttggaagcagagcttgcagtgagccgagatcactccactgcactccagcttgggcagcgagcaagactccgtctc

SEQ ID NO: 265539 - DNA, 682 bp, Homo sapiens
gtgatatttgccacctgtggtgagcttttgctgtggattacagttttatgatttctaatactgtggacagagatcagcagtgagagcccacgccccctttattgaattcaaaaatactgggacaaaaataatgtacagtagggggctaattttgatttccctgtccctaaggttcctaagccacctagaaagggagtaaccttaggggatacaagttaagtaaaagaatgccatgggcatacagaagaaatgataagaaaaggtgatatttttctttttaaagacttaaactgattattttttacaggagtaaccattcagaaaatactgcccttttaagctttccagaggatgacacacgctcttatggtttatagtcagaatccatgtcgagctgcacatgtgaaaaatgaatgtcatgttgttttcaagtagtaagctcaatgtttctaatttagttttttttttttttttttttttacaagttaatctaattttggtataagtggaaaagttgataattaaagaaagcaggtcctttctaacacaaagaccactaaggatgttttctccagcaattcttaataactttatagtttttattcccttgcaaaacatgggtttggggctgtgcagttagagaatatgtattgtttaagtgtaaattttaagcacataagga

SEQ ID NO: 265540 - DNA, 460 bp, Homo sapiens
ccaggctggagggcagtggcgcgatcttggctcactgcaagctctgcctcctgggttcatgccattctcctgcttcagcctcccgagtagctgggactacaggtgcccaccaccacacctggctaatgttctttgtattttttagtagagacagggtttcaccgtgttagccaggatggtttcgatctcctgacgtcatgatccacctgcgctggcctcccaaagtgctgggattacaggcgtgagccaccgtgcctggcccacagctgcctaatttttaaactttctgtagaaatggggttttgctactttgctcaggctgttctcgaactctcagcctcaagcaatcctcctgcttcggcctcccaaaccgctaggattacaggcatgagtcattgtgcctgatctccacattttcttgattatagtaagtctttaattcagtttgtgtaagttctcc

SEQ ID NO: 265541 - DNA, 1084 bp, Homo sapiens
aaagatacgtgtagatgcatatgcataacggcattattcacaaagctaaaaggtggaagcaaaccaagtgtccattgatatataaatggataatcaaaatgtggtatccatatgctgtattattaagtcttaaaaaggaaggagattctgacacatgcaacaacaaacatgaatcttgaggacattgtgctaagtgaaataagccagtcacgaaaagacaaataccactttgtctgactccacttatgtgaggtacctagagtagtcaaattcataaacacataaagtggaatggtggttgtcaggggctcaagggggaggggaatggggagttattgtttaatgggtatagagctatggatttgtagtgggtgcagcgatgtgtgcctgtagtctcagacactcaggaggctgaggaggaggactgcttaagcccaggtgtttgagcctaacctgggaaatatagcaagaccttcatctttaaaaaaataaaaaacaaagcttcagatgtgcaagaccaagaaattattgaaatggatatggtgatggctgtacaacaatatgaatatacttaataccactgaaatgtacacttacaacttttttttttttttttgagacggagtttcactcttgtcacccaggctgaagtgcaatggcatgatctcagctcactgcaacctctgcctcctgggttccagcgattctcctgcctcagcctccagagtagctgggattgcaggcacctgccaccacgcctggttaatttttgtatttttagtagagacggggtttcaccacgttggccaggctggtcttgaactcctgacctcaggtgatctgcccaccccagcctcccaaagtgctgggattacaggcgtgagccactgcacccagccaaaacgtttttataaagaggttttaaaaagatggttatgtgtatattatgtgtattttataattaaaaagttgggggaaacattttaaaatagtgaccatacccaattgttggtaaggctgggggcaaccggaattcatacaactgctaatagaaatgaaaaacggtacaactacttgggaacag

SEQ ID NO: 265542 - DNA, 336 bp, Homo sapiens
acttagtcctctgtcttaaatcattaaagcctctgagttagtttgtaggtagaacagccctcaagctgcccacaggtcatttcttctagcctgagtggttaagacaagaagttggccgggtgcggtggctcacgcctgtaatcccagcgctttgggaggccgaggtgggcagatcacctgaggtcagcagttcgagaccagcctggccaacatggtgaaaccccatctctactaaaaatacaaaaattagccaggcgtggtggcacgtgcctgtaatcccagctagtctacttgggaggctgaggcaggagaatcgctggaaccagggcggcagag

SEQ ID NO: 265543 - DNA, 363 bp, Homo sapiens
ttttttttgagacaaagtctcactctgtcacccaggctggagtacagtggcacaatcttggctcactgcaacctccgcctcccgctttcaagagattctcctgcctcagcctccctagtagctgggattataggcacctgccaccacgcccagctaacttttgtatttttagtagagatgggttttcaccatgttgaccatgctgatcttgaactcccgacctcaagtgatccacccaccttggcctcccaaagtgctgggattataggagtgagccaccgcgcccggccctagatgctcatttctaatgaaaacattgtgatccaaaagaattattgattaccaactcagcattaacttaag

SEQ ID NO: 265544 - DNA, 295 bp, Homo sapiens
tcgtgggagaatctctccttcccatttctagtgcacccaccaactctggaacagaatcctccccaccttctgcctgggcatgctttacactcccagccccacccgactccaggccatcttcggctctgtcaccagaagccttcccaggacctgggctatgtccacatctggcagtggggcactgtcagatctcatttgaaggctgcaaacctcacttcagcccagtttcactcagctttcccagtccaggttagtcaagtcccccaggctggcctctccagtacatcccagtgtc

SEQ ID NO: 265545 - DNA, 291 bp, Homo sapiens
tgagaaacattaattcacatttcaggaatgataacacactgtgaataggcttttggcatatactcagtgaattcacttacgttgactcatttgtcacccagaactaccctgggtgccactgcaagtgtatggctgtagaattaggagtgactgctatacctaaggtgctgtaactcactgataacccgcatctgcctgcctgagtttggtctgcccacaccaggctgcttttgcactgctaggagaccataagaaactaggccgagcggcagcaaccaactcttcagcaca

SEQ ID NO: 265546 - DNA, 295 bp, Homo sapiens
cccactgtgttgtcatggtgtactacatcgagatgctgtagctctcagtgtcccgctgtgttaagtcatggtgtactacatcgacatgctctagctctccgtgtcccactgtgttaagtcacagtgtactacatcgagatgctgtagctctccatgtcccgctgtgttaagtcacggtgtactacatcgagatgctgtagctctccgtgtcccgctgtgttaagtcacggtgtactacatcaagatgctgtagctctcagtgtccccctgtgttaagtcacggtgtactacatcg

SEQ ID NO: 265547 - DNA, 313 bp, Homo sapiens
ccagccaaccatagccagttggggatataaacctctaaaaaccaaaactggggaaaaatggctccccattttctgaggtactcttggagcacaagctgaatgaaaaccaatcatcattgccctgcctagcatgaagcagaatgaaaagaaggcagataatatttcctcccctgaaccactcatccatatctgctctattcagatatttgtgcctaggcaactgcacccacccctctcagcatttacccacagatcctcaaaaccaagccctagcacaatcgactccagtgaaaattaaaaaagctatcccaaa

SEQ ID NO: 265548 - DNA, 286 bp, Homo sapiens
agttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctg

SEQ ID NO: 265549 - DNA, 200 bp, Homo sapiens
ggcttcctgactggaaggatgaggtaaatggctagagatctgtagacaccttggaccctgagaatgtaagccatgtgctaagaaatgctgagcaggagaatgaaggggcctggatccctgctgataccaggtgccactgtattggttctgaactgcccacctctgggcttcctatgagaaagaagcaaactttaatcttg

SEQ ID NO: 265550 - DNA, 292 bp, Homo sapiens
ccccactgtccaaaatgactatttcaaaagacccctttttttatacactttatcctgaccctctctctcccagattttctctacttcacgaagcaaacagaagccatgggatctacattcatcttccacatgggaggaaccatcactgcatccttctgcctgattctgcaatggttttcctgaacacttaagacccaaacacccaaccctggccacaaacaatccttgcctcttggcctccttccacaccactgctttagctcctgccctcctgccatgcttgtctttgttc

SEQ ID NO: 265551 - DNA, 248 bp, Homo sapiens
gatgcgtggtggaggcaaatcactgagggtcgtgagcttgaaactaaagtttaaaggtcttggatttgagggtctcacattcagatgtctgcagggaccaggctgggagatgctgggagaacccccacgttctggggtggcgagtgcctctcaactgccgctggaagcgatctcagatttttcatgagaagttgaatatcgggatttttatgtgaaatctcttgatttgtaaatgttggcaatcaatt

SEQ ID NO: 265552 - DNA, 267 bp, Homo sapiens
gttgcccaggctggtcttgttcgaacgtctgagttcaagtgatcctcttgcctcagcctcccaaagtgctaggattaggattacaggcatgagccactgcactgggccaacattttcctctttaagtgcaccagttcatgagtcttgacagatgtatgtgattctgtaatcagtatcataatcgaaatctagaacatttcatcactccgaaacagtcctgtcctacctctttgcaatcatcctcctccatcgggtaatcagcctctg

SEQ ID NO: 265553 - DNA, 439 bp, Homo sapiens
ttgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaa

SEQ ID NO: 265554 - DNA, 168 bp, Homo sapiens
gtcaccattttgctggtgccacttgatgacgctgaggagtaattaccagtgattaattacttacacggcctgcgtgtttttattccagtccaattaaaatgcagtgcacaactctcagtgctagggcctgccgcctcctgggtccctctcctgcaaatcccagtctgc

SEQ ID NO: 265555 - DNA, 279 bp, Homo sapiens
gctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacaccc

SEQ ID NO: 265556 - DNA, 272 bp, Homo sapiens
cttgggctgagtctcaccatacataggcttctggtggggctgaggggtcagagatatgggcccctgcacgtgagggcccttggctctctggggaagcaaaaacgtggacagctgggaggtggtcagtagcacccagcgacgtggacccaggacaggcagcgagctcagtgcctgcggctgcatgtggggcagggaggcactgcccatccactgaacagagcctgatgcttcccccttgggggcacagtggctccccgctgggtgcagggaaa

SEQ ID NO: 265557 - DNA, 415 bp, Homo sapiens
gtaccagagaatattttaaaaatcacactcggccgggtgctgtggctcatgcctgtcatcccagcactttgggaggcaggcagatcatctgaggtcaggagttcaagaccagcctggccaacatggtgaaagcctgtctctactaaaaatacaaaaattagccaggtgtgatggtgcgtgcctgtaatcccagcaaatcgggaggctgaggcaggagaatcgcttgaacctgggaggtggaagttgcactgaaccaagatagtgccactgtactccagcctgggcgacagagtgagactcaaaaaaaaaaatcacactcctgactaaaaatttccaggaggtccttttagttttttgtgtttgtttttcacacacagaccaaccaactaaaaagtgactggggaaaaaaaggaaa

SEQ ID NO: 265558 - DNA, 509 bp, Homo sapiens
cgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaa

SEQ ID NO: 265559 - DNA, 403 bp, Homo sapiens
cctcatactgcttccactggcagaaatgaagttttgggaagtatagagggaaataatagaattttgtccagtagcaagaatgaggaacacactgtttattgcctgggctagaggagtcagagtgtgaggagtgtcaggccttggagagtgtttggctgagagctgaagttggcgtgggatttccatgttccatggctggtgtttggcatatatttctgcttttctgggcaaatagcctaaatctcctctttacttctcttggatagggtcttaggccaaaaatgccatactgcccccattccgttcttgcctcaaatctgtcacttagctcatttcagtggcttaaacctgcaattttttgatgtctactgaatgcaaataaagctgattcttgacaccgagg

SEQ ID NO: 265560 - DNA, 396 bp, Homo sapiens
gtatattcagcaattggtgctgggaaaactggccatctacatgcagaggactgaatttggatccttatctcaccctttgtacaaaagtaaattcaaaatgtattaaagacttaaatgtggccaggcgcggtggctcacgcccataatctcagcactttgggaggcctaggcggccggatcacaaggtcaaaaggtggagaccatcctggacaatatggtgaaaccccatctctactaaaactacaaaaattatctgggcttggtggcacacacctctagtcccagctactcaggaggctgaggcaggagaatcgcttgaacccctggtggaggttgcagtgagccgagattgtgccactgcactccagcctggccacaaagcaagactttgtctca

SEQ ID NO: 265561 - DNA, 286 bp, Homo sapiens
gaaggagctgaggagcagagaaaggccctgggctagaactgtgatccaggtgccaatcctgcctcttatgggctgggcacactgcacctctctttgggcttagtttctccatctgggaaatgagagttgaacaaagtttccaaggttctctctgctctgcattctctgaggtcagagaatgggggcagcaaagctgacagactgtgcctgcaagccaacaggagagatgaaaagcaacagttccacaggagagaagggcaagcagggaagccccatttgctaacga

SEQ ID NO: 265562 - DNA, 324 bp, Homo sapiens
ttttttttttaaacgtttctctcttgtagcagcaatcactttgtgtccgttatttatgtgcctgtaagcactgaccttggcacaatgcctggcagatagtagggactcaagaatatgttgacttgaataaatgaatgcatggaatgacaggatctcttgagacacaatctagcaaggtgaaatttattaaaggcaaatgtggatcaagaaaaccaattttacaagctcaaagatggaagggatatggtttaacagcaaaatgtgttaaaaattatttaggggttttggttgacagtttagtatgagtcaccaatgtgacccaaa

SEQ ID NO: 265563 - DNA, 481 bp, Homo sapiens
gatctcaccaaaatttctaatcacatatctttggtttttacttatatatcaatacatacaagacctttcctgggaaggtataggccccatcttcccttccttttatctatattataatgatcttcaagtaatgacttgagaagaaatggcctgaaaagttggtacaaccgcaggttgtctccctaaggcttggaccaggatttacttgacccagttacccatgacctggggatggacagatattcttgttgcaaatcccctgagccttgattctaggagtccagaacgttttacaaataaaaagatttagagatcgaaaataattattttgtaacacatagtagaggaagcagtagaccacatctggatacaaaccagagtgacgcatgaagaaccagagttagttacagacattagattgagaattattgacttttaatgaaacagacagtaataaattgatttcaacttaacttcctta

SEQ ID NO: 265564 - DNA, 351 bp, Homo sapiens
tagggccaggcaccagcctcagggtctcctctggatgtcaagtggggcacactactgctactgaggaggcagaggacagaccgttcatgcttagacccccctccccactacatcaggacactgtcaccttccagaccacacaactgagaaacagccacattataactagactccactgtcttcagcaggcctatcctggagatactgagaatcacatgaattttttggtttcccagtgaatataatccatgctgacactctactgcagcttattaaacattcaatagcattatatctaaaagaacaatgtacctaacttaatttaaaaatactttattattaaaaatcacc

SEQ ID NO: 265565 - DNA, 521 bp, Homo sapiens
agtttgaagagttgcccatctttggccaaaacttgctgattgttgcaagagtaggttacagtctgtttacacaccacattaggttacatttcactatgtacagagaaacctttaggctgaacctaaaacatgtaagaagtcagctttaggttaaacttaatttaatgcattgtatatttgaaaatttctaaaagaatagattttaagtgttctcattgcacaggcaaaaaataagtatgtgagttaatacgtatgttaagtggcttgatttgactattccacaatgtatacacatattaaggcatcatgttgtgcatcataagtatatacaatttttacttgtcaatctaaacattttttaaaaattaaatgtgggttgttaaatgaactgtaaaaaataagtaaaaggcgaattgagctccaaactaaagtgacacatagatcaaatatttttaacataagtttagaatttgaggcattttatcttcaaagcaaaataattgggaagtggaaaaaaaaaa

SEQ ID NO: 265566 - DNA, 452 bp, Homo sapiens
gaattccaatcacctgacccgggtctgaccgcagttaccagtctcaagtctgagcagcgtctccagtgctgggctgccttcttgactccaggaggcatgcctgctcttacaatgaaactcaagtctttttttttccttcccacaagtttggcttctacttttctaagtgctgttcatcatatactctgtgttgtaagtactcagctctctagcatctctttatactaccttttattcttctggaatatccttccttcccacccacaagcatattaggcaaaacttgcccaccgtggtaactggaaacaggactgaggggaaggaaaactctctcccaggtgcatggagtgggaactcatttagggcatctttagtgccatacatagaacctggaatacaataggagctcaattaatacatgttaaatggataaatattggttaaatgcatca

SEQ ID NO: 265567 - DNA, 449 bp, Homo sapiens
acatgtgttccagtggtgtaatgagtctttaggagaatatgatcaaggatcacttcgttttccaatttttcgtgatgtaatatgatgacttatttgacgttgaacaaattaccaatgatagttttattaaccataaatcatggatagttgaaacatcagtgtctcaaatctgcctgtttttatttcaatgtgttttaatatttcttgaatattatttagcagatttctggatttcaaaaaaaaaaacgaaatctaatagaataagcgtagtggattctgcattaaagtagctattataaattaaaaacctttaagttacagaattgaaacagtgttaatccacatgagataaacactaaaatcggaggtacatctataactagacctttcacattaaaaaacaatgtgttctatgattctttattaaatacattatgtaaatctacctt

SEQ ID NO: 265568 - DNA, 279 bp, Homo sapiens
tttgtgctctctccaaatgcatatgatgaaacctcatctccaatgtgatggtatttggtggtggggcctttgggaggtgattaggtcatgggagcagagtcctcaggaatgggattagtgccttccaactccctctgccctttcaccacatagacacagcaaagaggtggccagctatgcagtgggttcttgccacataccaaatctgccaatgtcttgatcttggacttcccaggcccagaactatgagaaataaatttctgttgcttataagccact

SEQ ID NO: 265569 - DNA, 747 bp, Homo sapiens
acgggtcgaagggctcctggaacgcggccagagcggacgcagaggccaaggaggcgccgagagcccagagcgagcaagggctgctagcacgttttcacctctcaataggaggaagtaaaggaaattttacctacaaaatagcaatactaagctttacagctgacattacaacagcaacaagaaaaggctagtgatatgcagtatgatgctctctccagatgctaggcagtcagccagcaaatcagtaggataaacaaccgacgttcttcagcgtaccgtgttgtcagatgattctgcccagctgcaggctaatgtaagtgtcctgaggatgttcaagtgctgaaatcaagacgtcaaccagctggtcttttttcgggaggatctgagaaaaatctgctttcaagtccatttagattctttgtctttttctatggaccaattgtcatctttcctaacagaagactacgcatccctgtgatacctctcagatgacaacaaagttctgtaaggtttcttgtgtggaaatgacaggacacatcctcaaatcctgccagcatttgtttagtaagagtgctggatcatttgagggttacttttaaatttcctgagccaatggtcctcctaagccaactattcattctgtgtaatggctgatgaaattaacaagggacaaaccaaatcccaattgcctatagagcggtacatcaaagatatgcatatccaaaacatagataaaatcatatatac

SEQ ID NO: 265570 - DNA, 999 bp, Homo sapiens
acgggtcgaagggctcctggaacgcggccagagcggacgcagaggccaaggaggcgccgagagcccagagcgagcaagggctgctagcacgttttcacctctcaataggaggaagtaaaggaaattttacctacaaaatagcaatactaagctttacagctgacattacaacagcaacaagaaaaggctagtgatatgcagtatgatgctctctccagatgctaggcagtcagccagcaaatcagtaggataaacaaccgacgttcttcagcgtaccgtgttgtcagatgattctgcccagctgcaggctaatgtaagtgtcctgaggatgttcaagtgctgaaatcaagacgtcaaccagctggtcttttttcgggaggatctgagaaaaatctgctttcaagtccatttagattctttgtctttttctatggaccaattgtcatctttcctaacagaagactacgcatccctgtgatacctctcagatgacaacaaagttctgtaaggtttcttgtgtggaaatgacaggacacatcctcaaatcctgccagcatttgtttagcattcataaagctttatctagacaaattcacaaagacagcaacaataatgatgctgccgtggaaaaggccaaaggtaaagaagagacaattttccctccaaaggcagccgctttctgacttctgtaaccgtctgtcagttcatccctttgattgcctggcatcatttgctccgtgtagtgtctgcaagattcctccattctgctgtgtatttcagtgatggattcccttattgctgggagattaggatacacaaaaagagacacgagcaatatgcgtgtgctcaaaggggtgaccacgtgaagaggaagcaagaaagggccatggacaacccaaagaaagaggcctcagaggagtacagtcctgccaccttgatctcagacttccagcctccagaactatgagaaatacatttctgttgttaaagccatcctgc

SEQ ID NO: 265571 - DNA, 477 bp, Homo sapiens
tcccttcatatatctgtttagtatagggccaaacaaatcagctaatacgggctccaaatagccactgtgaaaatgttagagtatatttgtgcttacttttataaaaggttaattatttggtataaattagggaagtcccaagcatttacataaaattttataattattaggattttgttaattttggatatttggattttatatatatatatatatatatctacctgagactgtgttttaatatctttatgtttgaaattagcaaaataacttttagttaccaattcatatgaatatgatactgcttagtaaactagatctaaaagaaataacttaaaattcaaaagaaaagtattccctaaatgtattcatgaagaaagatgattagctttttatttgtggaggttgtggtgagccgagatcataccactgcactccagcctgggtgataaagcaacagtctgtctcaaaaaaaaa

SEQ ID NO: 265572 - DNA, 337 bp, Homo sapiens
ttgaggatcactaaagcatcactccccaaataacttaaaattcaaaagaaaagtattccctaaatgtattcatgaagaaagatgattagctttttatttgttggagggaattttctaatttgatttgatttatttaatggaagggataatattttaagatcaaatttagagtaattaaatatactattactatgtatgttactattataatgtaagcatatgagtaaaaaacctcactatagctagaaactataaagaaaaagtattcaaacatatttttcaacagctgtactaagtataagggactctgtttggtgctgtgaaaaatacagaggta

SEQ ID NO: 265573 - DNA, 525 bp, Homo sapiens
ggtctcccaaagtgctgggattacaggcgtgagccaccgtgcccggccgtggtgtcttgagctgagtgcagaagcgcaaatagggggtaggagaaaatgcaccgcgaggagaaatgtgctgcgggcctgctgtctagctgtgtcatttggtcgttgcggggccctgtgaggccgggagggctgccagcacccaccatgtgccaggcctcgttgctagtgctggggccagttcctgccccggtggagctgccactgaagggggaggcgtaataaacaagataggtgagtgcatatgcagcgtggtctgttgtgctgagggctgaagagaaaccagaagcagggctcagaggccaggaggactctgcaaagggatttggcattatcacagggtggccagggaagatcttcaaggtgacagtgagcagagggaggtgagggagcctgtgtggacttcaggactagagctccaggcagggcctgtttgaggaacatggaggaggcgagagcaaggagtagaggtcaaaa

SEQ ID NO: 265574 - DNA, 443 bp, Homo sapiens
ccacccccaatccttccactctgcagaaactttaaagcctcacttccaatgccttctcgaagctagatgtgctaagaccttcttgatcttataccgccgtcatggactcctgagatgagggtgtgacatagctaactatcatattatttatttataatatgaaatatatttgggctttgtccctggttcctgacacagcccctaaaacccttgaatttcctgggttatacgtaatgggtctctttgataacacctgagtttataataaggaggtgatttaggatgggggccctagataaccttaggatggggccagtcaccagagagaccaagtgattggaggattggaactttcatccccacccttcaacctccaggaaagggggaggggaggagctggacatcaaactctataaacgctcgaacaacaagagttgatgagc

SEQ ID NO: 265575 - DNA, 1508 bp, Homo sapiens
ggcacgaggatccgatgtaagtcttctttcttcaaaggtgggtgtgtggacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacaggtcattttgagagtaaattctctcccacgtgatggattcaaaaccttttggagccagtaaacttagttccatttcacaggtgcacataaagaccttcctgcccacctcctatggacatgtccagggatacaggacaagagtggggttagaatggtagagtccaccactcttactggaaagagcttgagatttatcacctgctaatgtgaggtcattttcaaatacaaaggagaggttattatgttaaatgtggttgcccttagacctattccaaatcccaactggtatttttttttaacatattctaacctgttctaacctctaagcattttctaatggaacaaaatagatgaggtggatgaacatttgtggcttttcttcagagactcccttttttgtcttaaagaattacgtctggtggcacgttggctcatgcctgtaatcccagcactttgggaggtcgaggtgggaggatcacttgaggccacgagttcaagaccagcctggccaacatggtgaaacccatctataccaaaaatacaaaaattagccgggtgtggtgatgcacacctgtaatcccagctactcgggaggctgaggcacaagaatcgcttgaacacgggaggcagaggttgcagtgagccgagatggcgccactacactccagcctgggttatagagtgagactctgtctc

SEQ ID NO: 265576 - DNA, 2007 bp, Homo sapiens
atggttggttgcatcggttctcacgtccgcccgcagaaggtgacggttctttgcactacgtcctccctagcacctgacgctgccagacgtttcaactttggacttttcgactcaacttatggtgagtgtggtattatccgctgtggttttaattggccatcttctgattattaatgaattaaagcatcatttcaataaacagatatttattggccatttagatttctcgtgtgtttgtgaaatacctttccatttacccattatttaattgggttccttttcttcttgatttgtagcagttcctcgcgtattttagtagttttatttgtggcaaagatctcctcccccgggtggcctctgccctccggcgctgggaagtcggggcggcgaggcagcctctcccggggcgttcgggctcctccggctctgccccgatgtcgttattacggccgtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacaggtacgtagtggctactttaaaatgtcttctgaaacattaaaccagaatttgcgtttgtttgcagtgtctagataccgcttcctttaagatgacgatgtcatagcagccacctagctgggtaaaacaaacgcttccataggctatcctgtatgtttatgtttattccataaattcttatgaccaaaataaaagccaccaatggtttacagtgtaattgctacaagtcgattattgctataagtcaattattatatccaaaattgctataattgctataagtaattataagtccattgttatgtcagttattatatccgaaattctccattcaaagaaatctggaactttttaaaactgtgttttccaaatgataaaatatagaacttaagcatttg

SEQ ID NO: 265577 - DNA, 807 bp, Homo sapiens
agaaagaaagaaaaaaggaatgctcaaccgcatttgttattatttttttttttttggaaacggagtttcactcttgttgcccaagctggagtgcaatgacgtgatctcagctcattgcaatcatttagtgtgattaagctcattgcactcattaatcatttagtgtcattaagctttcctggtgtctgaaatcacatcaactaggcatttatcttaaatccatgatctgttaacatatctttggttactagtgatctccataatgacataatttatctcaaaagactccttggtttgaaaatctgattaaccactccagtatattttccagacttgaaaactggtatttaggccaggcatggtgattcatgcctgtaatcccagcactttgggagactgagccaggtggatcacctgaggtcaggagttcaagaccagcctggccaacatggtgaaaccctgtctctactaaaatacaaaaattagctgggtagggtggtgcaagcctgtaatcccagctacttgggaggctgaggcaggagaagcacttgaacccaggaggtggaggttgcagtgagccaagatcatgcctctgcactccagcctgggtgacagagtgagattctgcctcaaaaaaagaaaaaagaaaattggtatttattgcttctctctacagatgcttctcaatttatgatggggttacaccctgacaaactcataagtcgaaaatacacaaagtcgaaaatgtgttcaatatacctaacttactgaacaacatagcttagcctagcctacatgctcagaaca

SEQ ID NO: 265578 - DNA, 800 bp, Homo sapiens
agcgggggaataccaggggtgggcactgtcaagagacccagctttgacttcaaatgccacccagagggacaactgctcactttcagagcaggagcaggaggccagaggagagtgggtccctatgatccagacctcaagagagggttcctggacctcccacagaaagggattcaagaccagctgaaactgattagagccaagatagccaaccaaatgacttcaggaagacctcaggcttcattatcatctcatttccatgctaaaaaaacccagctccctagaacaatgggaaatattgggcacttcatcaggcgagttcaggtgcatttctagagattgtccaggtgctggtaacaataatagagaaccatccatatccacaagaggcagaacctcttccagcaaaatggtgctgcctcacccaaaggtggccgaggaggccgtcggaggaccacaaagctgcaagtggctttcctgcggcctgcagggaacaggtggaggacacttggaagggcacccaccccgggtctcacaggagtctgcacccgcaggtcacactggcattagcccctcatcctctggagttcatctcatccaggcgaagacagctggctggcctcagagggtgagacgcaactcgagggtaaaaacatttttacagggcatggacacaaaagtggcctttacctctggataagcttttaaaacttcccatttacatgtaaaggtgtactttctatgtgccaccaagaaacctaaagtgagtaaaaggtgtttcactttaatcaagttccccaatg

SEQ ID NO: 265579 - DNA, 751 bp, Homo sapiens
agcgggggaataccaggggtgggcactgtcaagagacccagctttgacttcaaatgccacccagagggacaactgctcactttcagagcaggagcaggaggccagaggagagtgtgagtctaacatctgcacagtgagaagtccaggagaagcaaaaatgagatccaggctggagcggctgtgccagagggtccctatgatccagacctcaagagagggttcctggacctcccacagaaagggattcaagaccagctgaaactgattagagccaagatagccaaccaaatgacttcaggaagacctcaggcttcattatcatctcatttccatgctaaaaaaacccagctccctagaacaatgggaaatattgggcacttcatcaggcgagttcaggtgcatttctagagattgtccaggtgctggtaacaataatagagaaccatccatatccacaagaggcagaacctcttccagcaaaatggtgctgcctcacccaaaggtcacactggcattagcccctcatcctctggagttcatctcatccaggcgaagacagctggctggcctcagagggtgagacgcaactcgagggtaaaaacatttttacagggcatggacacaaaagtggcctttacctctggataagcttttaaaacttcccatttacatgtaaaggtgtactttctatgtgccaccaagaaacctaaagtgagtaaaaggtgtttcactttaatcaagttccccaatg

SEQ ID NO: 265580 - DNA, 412 bp, Homo sapiens
agcgggggaataccaggggtgggcactgtcaagagacccagctttgacttcaaatgccacccagagggacaactgctcactttcagagcaggagcaggaggccagaggagagtgtgagtctaacatctgcacagtgagaagtccaggagaagcaaaaatgagatccaggctggagcggctgtgccagagtaactgttccagcgggtgtgggggagggtcccccaaaaagacttacctggactgaatgggaaataatagaaaataggagcaagagactgtcactttataataggttctgttatgacctcctacaacaatatgttagaaattatgatttctaatatgtctatgatacagatagacatatagttagaaaactaaataaagagacagattttgagctaggtatact

SEQ ID NO: 265581 - DNA, 174 bp, Homo sapiens
gctgctatgaacattcatatacagtgtgtgtggacatggattttcaatactcttgggtacatacctaggagtagaaatgctagtcatatgagcaattgacctagctttcttggagtgcactggcatgatctcagctcactgcaacctccgcctcctgggttcaagcgattctcc

SEQ ID NO: 265582 - DNA, 365 bp, Homo sapiens
gagacagagtcttgctccgtcgccaggctggagtgcagtggtgcgaccttggcttgctgcaacctccgcctcctgggttcaagcgattctcctgcatcagcctcccaagcagctgggactacagataaacaacaataaaaaaatgaagagacaagaagtcaagagacttgcccaaagagacccagctaatgcagatggcagaggcaggattcaagaacagatcttttcattctaagtccaggacactctccagtcaccacaggctactgcctgtgtgttgattttattttgtgagtgggttgcattcattttcaagggtgtgtaggaatttagaaagcagaataaaccaaagagagcaaacagga

SEQ ID NO: 265583 - DNA, 358 bp, Homo sapiens
gggaggaaatgaatgctaagagagtgaggtgattcatacagctgtgaaactgcaggttcctgaggacaggagccgcatctttttcatcttttcattccttatggcaccaagtgcctaataaacaacaataaaaaaatgaagagacaagaagtcaagagacttgcccaaagagacccagctaatgcagatggcagaggcaggattcaagaacagatcttttcattctaagtccaggacactctccagtcaccacaggctactgcctgtgtgttgattttattttgtgagtgggttgcattcattttcaagggtgtgtaggaatttagaaagcagaataaaccaaagagagcaaacagga

SEQ ID NO: 265584 - DNA, 516 bp, Homo sapiens
tggaggagtgaggtgcaaaaataagaggtgatacctctcatgctcacatgtatcaggaccagtcacctaatttgtggggcttagtgcaaaagaaaaatttagggccactcattcaaacattattaggaatttcaagagctgggcatgttggagtatgcctgtgatctcagttacttaggaggctgaggcagaaggattacttgaggccaggagtttgagtctgtagtgtgttgtgattatgcttatgaatagccattgcattctaggtggagcaacatagtgagaccccatctctaaaaagaaaaagaaatgaaataaaataatttcaagacagtaacaactgagcattaaatgaagcatagagactgtgtaaacatgggactgtgattgctgcagaggccatagacccatgtagctggccccacatatgagcatatccatatataaaagtctgtttttgaagacccatttttattttttaggccccaataataaatgatcaattattagtagtta

SEQ ID NO: 265585 - DNA, 748 bp, Homo sapiens
gtaagtggaggaatactttttttttttttagtgtgtgtgaacattccacccatgggtaagtggaggaatacttttttttttagtgatgtaatctcgttctattgcccaagctggagtgcagtcccatgatcatagctcattgcagcctcaacctcctgagcccaagcaatccccccacctcagcctcccaagtagctgggactacaggtatacaccaccacacctggctaatttcattttttaaatttttttgtagagatggaatctcattttgttgcccaagctggtatcgaactcccagcttcaagtgatcctcctgccgttgacgcctcccaaagtgctgaggcaggaggattgcttgcgttcaggagtttcagaccagcctgggcaatgcagggagacctcatctttactaaaaataaaaaaattagccaggcatggtggcacatgcctatagtcccagctactcaggaggctaaggtggaaggattgcttgggcccaggaggtcgaggctgcaggaagctacgatcatgccactgcactgcaagaccttttttcaaaaaaaataaaaaaaaataaaaataataataataatatatggtgacatcaaagaagatttggataaatgaagttctgctaaaaagacaataataattccaaatgtagatacaaaaactataaaaatgtacaaaataaactagcataaatgatactttctgcacacaaaacattaccgtttgtctacag

SEQ ID NO: 265586 - DNA, 189 bp, Homo sapiens
aaaatgatgtgttaatgtcagttcatcagctgttacaaatggaccacgccggtacaggatgttgatggaagcaaccgtttaggggtgggggcaggcatatgggaactctgtactttctgttcagttatgctgtgagcctaaaactgctctaaaaacaaagcctaataagaaaaatcacacgctaggtct

SEQ ID NO: 265587 - DNA, 649 bp, Homo sapiens
ggcagccaaaataagaattgtccttgctcatagtacaaccctttaattgacttgtgcctgagttttggtgtgagctgagtattggtggttatgaatactgggatccccagctatttgttcatgtacttattgaggtcactattggtcttccttcttcaatgaagggagaagctctgtcaaatgtagactgcaaagtcaagctcattaaaagtatccctctttcttcgtgagaaaaggtatccaaggagaattctgtccctggttcctcccatgtgggggttctaggcctaggaccagatcttattgtctctgcaatcttgattctttagtatttcaggataggcagagttttgttaaagtatacaaaaatcatagctagataagagagataacagaaataagttccagtgttctatactcctgtaggatgactacacttaatgctaatatacagttacaaatagctagaaggaggctattgaatgttcccaacacaaagaaatgataaatgtttgagatgatgatgtgctaattaccctcatctgaccagtatacattatatgtatcgaaacatcgctctgtgccctgcgaatatgtacaattgtgattattaaaataaatacataaataaaatttaaaagtcattatg

SEQ ID NO: 265588 - DNA, 491 bp, Homo sapiens
tctctctcatggatattagaaacactgcttttcctttgtgtgagaataaataactattaatataaaaattttctatgatatagaaaatgggaacactatttggtgttaatcattaaacggtcttgatagaatcaacctgctatttagtttcagaaaaattgagactttggaggggaaatgactgttaaaatattgtctttgtcttctgagaatattttgtcttgttttctgctgtgtccacctgggcaacacagcaagactctgtttaaaaaaaaaaagaaaagaaaaggtatttagattgtaaaggaagaagtaaaactctatttgcaaatgacataatcttggatatagaaaattctaagaaattcacacatacacacataaagaaaaagactgttggagctaataagtgagtctggtaaggctgcaagatactaagtcactatacaaaatttaattgtattcctatatattagcaattaaaatccaaa

SEQ ID NO: 265589 - DNA, 524 bp, Homo sapiens
caacattagatgtcacaaagagatcaagaagagttcgatcagaaagtgtcaaatgattgagaaaataagaaaaaatagtctgagaatgtgaaagtttggagcttgaaagagggaaaggagacttaaaattcaggtggcattgaaataaattagagctctttatttccagcaatgtggtagattaggtgtgcagagcaagcaaacaccttgttatctaaaacctgaaaatacatggacaacatttcttacagtatgactgaactttgaagtaactaaataggaaaccagaaacttcagaaagttcaattcaacagagataaagagcattagagctgcttgacatctgcttgatccctggtggctgggagtctggtaattggaacacatccagctggaagagacaaaagacagagcctaggactctagtagaacaaaaaaccacatatgcataaagttggaacccccaaaaggtgacacttaacaatgtacgggaaaatagaaataaacctatcatagaaaaggaa

SEQ ID NO: 265590 - DNA, 387 bp, Homo sapiens
acaaaactggaatacagatagtagattagataagaatatcacatcaatgttaaatttgctgaattcgataactgtattgtggttatgtaagagaattttttttgaaatatttaggaataaaagtttaggtcttggttgtatgcaagttactttcaaatggtccaggaaaaaaaagtgtatatgtatgtgtgtgtgtatcttgatacatatatatcatatatattacatctttatggggaggtgagaatgataaaagcaaatgaggtaataagctaacaattgtttgaatctatttaaaggatatattggtattctatgttcttattcttgcaacttctctgtaaatctgaaattattttcaaatacaagttaaaaacaaaaacccca

SEQ ID NO: 265591 - DNA, 484 bp, Homo sapiens
aatattctcgtttcttcattctccatttttctgtaataacttcagagccgtggcagaggatcaccccaggattggggtgctttccctggagcctgccttgtgaacctgcaaatcgccaagtgaatacctcagcctcagggcaggttgtgggctgatttttattttttcttttgggagggaagtcttttgggaaggtcagggggctacaggatatgaagtctggatttgagaacgtgccggaaataaaactgtgctctaaaaatctttcaggtttgctgctgattaactatctttagcaacccagcccagagtaagatggaaaagatgagctacacttgggccaaagtgcctttgagatgagccctgaagccagtctcagtgtttagccatcaccagagacacttcccaaagccttaacttttccttcactttgtactggaggtgggggccttctggcactgaatgcaaatctaccaaaaaaaaa

SEQ ID NO: 265592 - DNA, 439 bp, Homo sapiens
tgcccatcactttgcaggcttatttcctgaaattcagttttatctttgaatatgtaaaatatttacagagttcaaaagttaaaactacaggtcattccttggtatccatggggcgactggttccaggacctccccccaataccaaaatccatgtgtgctcaagtccctgatataaaatggcatacatagtatttgcatataacctatgcacatctttttgttttctaggttgcttatataatatgtaatattatctctaggttgcttatctctaggttgcttatctctaggttgcttgtaatatgtaatacactgtaaatgccatgcaaatagctgttatactgtattgtttaagaaataatggcaagaataaaatctgtacatgtttagtacagatgcaattttttattctggagaattttgatctgtgattggttca

SEQ ID NO: 265593 - DNA, 539 bp, Homo sapiens
cgagacggatattctggctctcaaaaaagggctgccttactgaaatcggggatcctagtgaactctatctttgctttgtctgaaaaataataaaaggggggttgggggagcggtggattcaagaaaagataaggtctacggatctatgggtctttgaccacacttggggggctgggctgacttctgcctttgtagttggttgaaacttattttccacctttcttctgctggtggcttcgtgaaacaacaccccctctttctctagagctcctgaatgtccacatgcaatgtctacaaaggctctgggcccgggaaatgtggatccatgcggcttgccgccatggaatgtttttcttgaaagcatccttgtctgcctggacccctgtgctcttcgcaactactcaagatgtggaggggacgagcaccagggggcaccagaccgagtaggaagccggactcgggagcagactgcagtttaaaagcctcagtccaaccggtggagagcgggaagcgctgaaaacgtacgcaaccgcatcaga

SEQ ID NO: 265594 - DNA, 190 bp, Homo sapiens
ctgcttctaaagaaaacaatagtttatgtcagagtggtgaatatttactgggcacttactctgttctaggcacggggaggtaaaggtggttaggatatagacactgtctagaaagagagacgcacaaataggtcattataatatatcatggaagatgctaagatggaacaacacacagcacaaaaagagg

SEQ ID NO: 265595 - DNA, 484 bp, Homo sapiens
tgttttgcgaatgtattatagtttatttttccagcagcagcaggtgttcctaattatggttttctttaggctaatactggaattagctgacacactctgagtgtgtgtgtatatatatatatagaatatgatatataaaaaacatgttgggtaactgagcagggagaaccgacccaagactcaagctgtttgatgtacaatttgcctgcaaagtcttaatttttttttttttggtaacttacctgtcagatttcacacattaaatgagaactgttcctcaccttgatgggctgcataccaactctaaagacgccataatttttctgacattctcaaaatttctatttgtgatttacctccttttcctcagtcatgggagaatctgggcttctgtatcagcctgttcattgcaacgtctgtccctgaaggactttgggggctgggaggaatgcactgggatcagaatgagactgcagggcttcag

SEQ ID NO: 265596 - DNA, 363 bp, Homo sapiens
aggaaagtaaaagaacatgaagcagtaatttgtgttggattatgatggataataatcatataaaaagtttcattctcactagtaatagaaaaaaaggcaaacaaaatcaagagcgtgtaaaagatcttccatcttgatagacacatccctggggtgtgacgcagcctcacacgcgagggtgacgactaaatctctccggagagtcatctcactccaagagggatccgcgcccgtaatatgtcccaaccctctgctgccgtgaaatcactcaccgcttcttggaatctcttctaaggaaataagcagagatgcagacaaagatttttataaacagaaggtcactttcattttattttaaatggt

SEQ ID NO: 265597 - DNA, 190 bp, Homo sapiens
tggcctcccaaagtgctgggattacaggcatgagccaccgtgcctggccgagactaaggatttttaatacaaaccttacacaaatcatagctagcctttagaaagctgattctggaggcaaagaatggctaagcaccacagagaggaaatctgttaggaaatgaaggatacagttcataccagaggcaac

SEQ ID NO: 265598 - DNA, 226 bp, Homo sapiens
gggtattttcattttattatgacttctgaatactccacagtaattttacttcttaaaacaatgaaaataaaatttccctgtaccttgaaaattagctggaaaaaaaaactataattctttacattagggtcaaataaatgttaaattcttggagcacccccaacatccagtatctcatcagacaccatttgtccctctatgaataaaataaatttgtgtgtgtgta

SEQ ID NO: 265599 - DNA, 403 bp, Homo sapiens
agcctgagcagctggagtaatgttagaacaaataacaaaatatacaatcacaaagatgtgattttagaatattacatctttgttttgagcaatatctcaaaattacattttcttctaagaaaaataataattgcggcagggcatggtggcccacgcctgtaatcccagcactttgggaggccaaggcgggcagatcacctaggtcaggagttcgagaccagcctggccaacatgatgaaacctcgtctctactaaaaatacagaaattacctggcatggtggcacatgcctttcatcccagctactcaggaggctgaggctcctcccaggaggcggaggttgcagtgagccgagatcacaccacttcactccagcctagatgacaagagcaaaactctatcgc

SEQ ID NO: 265600 - DNA, 413 bp, Homo sapiens
ttttttgagacggagtctaattatgtcgcccaggctgaagtgcagtggtgcaatctgggctcacagcaacctctgcctcctgggttcaagcaattatcctgcctcagccttctgagtaactgggactacaggcgtgcaccaccacacccagctaatttttgtatttttagtagagatggggtttcgccatgttggccaggctggtctcaaactctgaacctcaagtgatcctcctgcctcggcctcccaaagtgctgggattacaggcgttaagccaccgtgcctggcctcagtgaataatcttgtacagtagtcctcccttagtcaagaccctcacagtggatacctgaaatggcagatagcaccaaaccctatatatactatgttttttcttatatacacacataactatg

SEQ ID NO: 265601 - DNA, 669 bp, Homo sapiens
acaacccagctagttaaacgtgagcattaaattttttttaaaaaaaatccccctagtttcccaagacagcatttccatgaatttagtcttctgtaaatcactgggcatttccgtgagccctttctgcctccactctcttctctgtctttgcagtttccttatccccgaccgcgcccccccttccaacccaatcaccccacaaacaagatttctagacccagtataaaatgatccttttagtgacagtttcttgttatctggccgatccactggggaccgggctgcagcctttaaaatttttgatcctggaggccgccgagctgaactttccggcaggacccgggcgaggggggcttagcccttcgtttcgatcttcccaccaacatccgagagcctaatcagcgcgcccacggaggcgccttaagggcagttggggaagatgagcagagccgggaaacagcaagaggtatagaccctctgcagcacctctccaattccgcggcccttccgggtggcgtatacagctccaggattgggaaaggggctccggtggcccggcccgcaggtctccccgcgccccggccgcgcccacaggcccgccccctagccgccggggttgctatgcgttgccgtgaaacgcctgtcaataaaccctgtttggacagtgag

SEQ ID NO: 265602 - DNA, 819 bp, Homo sapiens
acaacccagctagttaaacgtgagcattaaattttttttaaaaaaaatccccctagtttcccaagacagcatttccatgaatttagtcttctgtaaatcactgggcatttccgtgagccctttctgcctccactctcttctctgtctttgcagtttccttatccccgaccgcgcccccccttccaacccaatcaccccacaaacaagatttctagacccagtataaaatgatccttttagtgacagtttcttgttatctggccgatccactggggaccgggctgcagcctttaaaatttttgatcctggaggccgccgagctgaactttccggcaggacccgggcgaggggggcttagcccttcgtttcgatcttcccaccaacatccgagagcctaatcagcgcgcccacggaggcgccttaagggcagttggggaagatgagcagagccgggaaacagcaagaggtatagaccctctgcagcacctctccaattccgcggcccttccgggtggcgtatacagctccaggattgggaaaggggctccggtggcccggcccgcaggcgcctggcctcgaagccagagggaggagtgcggggcgtggggtcggggggtgccgggcagaggaggaagccgtgtccgggtccgctgggcgaggggtcctgggtcaggggtcctgggtcagggccggtctgagccccggtgccccgcaggtctccccgcgccccggccgcgcccacaggcccgccccctagccgccggggttgctatgcgttgccgtgaaacgcctgtcaataaaccctgtttggacagtgag

SEQ ID NO: 265603 - DNA, 484 bp, Homo sapiens
tcgagctcggtaccccctaggtatatgtcgtgctgagtcaacttaatatggtaatctctccttccaaccttcattctagagcgattgaacgctttacagcaactgaatgattttacgtagatcttttcatctctaacctaactcagaaaataactctagccactgaaaagccaatcagcaaggggcttctaaccatgaagttccttttgcacatatgagactgcatgccaccctctgtacccggactgcctcctgctgaaagcacatatcttacttcacagatgactaaagttctgagccaatcaaaggatttaaaactaaactaactaaaatagttacaaggattaactaattttgttttctgtaaaaaatcagaagattgaagagatcaattgcttttatgttatgctctaaaccgaggaacaaagggcctgctctgattccctggcacgacatatacctagggggcatgttacagacctgc

SEQ ID NO: 265604 - DNA, 383 bp, Homo sapiens
tcgagctcggtaccccctaggtatatgtcgtgctgagtcaacttaatatggtaatctctccttccaaccttcattctagagcgattgaacgctttacagcaactgaatgattttacgtagatcttttcatctctaacctaactcagaaaataactctagccactgaaaagccaatcagcaaggggcttctaaccatgaagttccttttgcacatatgagactgcatgccaccctctgtacccgatcctggtgagtgtgccgctggtggagccgcaggtgatgcgcaatgtgggcttgataaaacgccgcgggcggacattgccgccggcggcgttggagttggagcgactggtgcgagagatgccgttcgcacgacatatact

SEQ ID NO: 265605 - DNA, 281 bp, Homo sapiens
ccaacatggcaaaaccccgtctgtactaaaaatacagaaaaaaaattagctgagtgtggtggcacatgcctgtaatcccagctactcaggaggctgaggcatgagaatcctttgaacccaggagcctgaggtggtagtgaaccaagattgcacgactgcactccagcctgggtgacaaagcgagactctgtcttgggaaaaaaaaaatacagagaagattggaaaatattaaatgtccatgaaacaaccatccagaatgaataaattttttatgaaaagtt

SEQ ID NO: 265606 - DNA, 784 bp, Homo sapiens
caggcaaaaggatgtgggggaaacctcactgtggctcatcaccacgtccatctgcctcaccaagttcccagcaaggagtcggccctgatgggtgtattcctcagccacagctcctcagtgggccagcaaggtgactcgaagggcctctgccacctctaagattggggaacaggaaagatggacctggccccaccccagcctgcgggtcaccacccatggcgggacaagtgagaaaagttggccttgctcaccgctggagcccaaaccacaggtttcatttccccttgataaagacaatgtttgctattgttgcatctgatggtaaaagcaagtcatattcactatcaaaaagtttgaaaggcggccgggcacggtggctcacacttgtattcccagcattttgggaggccgaggcaggcggatcacaaggtcaagagatcgagaccatcctgtccaacatggtgaaaccccatctctactaaaaatacaaaaattagatgggcatggtggcgtgcacctgtagttccaactacttgggaggctgaggcaagagaatcgcttgaacccgggaggcagaggttgctgtgagccccaagattgcaccactacactctagcctggcaacagagcgagactccgtctcaaaaaacaaaaaaaaaaaggaaaataagaatccagcctcaagcctgtcacccaggaacaatcactctagttggctggtgtatttccctccagtctttttttcagtgtatgtatataaactttatttatatatattatttta

SEQ ID NO: 265607 - DNA, 592 bp, Homo sapiens
gatggacatctgttcccagcacagagagcttctagggtcattaggtttttgttctcagagatattctgattggtaaaggatggggtgtttgactgagtgtggagttggcaacaaaaatattggcctcttttactggagcgtgtccctgaaaaatggacaggagagctaatagacaaacaaaatccacatggaagtgtggtggctgcaaaacgaagttcacagaatttcaggcaaaaacatcatatatgtaatttaccaaacagtggaattagaagaataaaaaccacaagagttggtgaagttgaagaggaaactccatgtggagacacggcgccgtacttcagacctcccggtctactaatactgatggtgtggctggaacctggggtgtgtacagccctatccagaggatgctcctgtttcggctgattcctctacaccttgtgtggggaaggtgggcaccagcggctccctagccgcagcagcctcaagtgcctccgcagccttttcagcttcctcattaaagtaaaaaaaagtgtgttcttctttgaaacctatttaaagtaacaataaagtttactgtctaatccaa

SEQ ID NO: 265608 - DNA, 414 bp, Homo sapiens
tctctaaaatggccgctctgggagtgtctgtcttatgcggttgaagataagggatgaaatatgcccgggtctcctgcagtgccctcaggcttgctaggattaggaaattctagcctggcaaattctagtcagactggttgtctggtctcgaactctgcttcctgttaagatgtttatcaagacaatgcatgcccagtgggacatggaacctcatcagtaattctaatttcaccctggccttgtgatctcactctgcccttctgcccttgtaatcttttattgccccttgaagaatgtgatctttgtgatttactccctgttcatacccccctccccttttgaaatccctaataaaaacttgctggttttgtggttcagggggcatcacggaacctgctgacatgtgatatcacc

SEQ ID NO: 265609 - DNA, 370 bp, Homo sapiens
ggcccttctaccttctgtcctgtgaggacacagggttcctccccttcagagaatacaatattcaaggaatactattgaaagcagagactggaacctcatcagacatcaaacctgccggcactttgattttggactttccattcaccagaactgtgaggaataagttttaatttttaataaattacccagtctctggcattttgtcacagcatcacaaagtgacctaagacaaaaagaaaataccttctaatgataagaataaagagtgttggacaacaatggggtggaaatcacttctaaggagtacaaatggggcctgatcaaataacatttattttctccagtttaggggaatcagatgacagtttcc

SEQ ID NO: 265610 - DNA, 433 bp, Homo sapiens
tactcaacgtagtactggaagtactaaccagatccatcaggcaagagaaaggaatgaaaggcatccgaattggaaaagagaaagtcagactatctctgtttgctattgatatgattgtatacctagaaaactccaaaagactcctagtttgataaatgaattcagtgaagtctcaggctacaaaataaatgcacacaaatcagtagcagtcctatacagcaacaatgatcaagctgagaacaaatcaagaactcaagaaaaagaattttcttctgttacctttaggtttggtttattcttgtatctctagttccttgagagctagagatgtgttttagaaaagaactcaatgcctaaactaaactatttaatagggtgtcttttccctattgggttcttttctagaagaactcaatcccttttacaatatctg

SEQ ID NO: 265611 - DNA, 281 bp, Homo sapiens
aggaaaaacaaagcctctgttaaagctctgcttacaatgaaatgtaactgaagttctatccaattctttcctcttctctgtaaacttgttcacatgcaacagcctctctgatgttaacaggctgttcctcccaagtgcctgcagatcatggctataggagtcactggaaggaacttgactcggtggcagtttggaggcttcccgggctttaatgatgaaaaatgatttggtcatttaagacagagccccccgctctgttgcctaggctggcgtacagtggc

SEQ ID NO: 265612 - DNA, 323 bp, Homo sapiens
gaaatggaagtggaggggaggctttgtactcagtaggaagtttgccagtgagtaacagggagcagcagtggaagagggagacagagagaaaggaaaccgacattattgaatgtattgaggcctctgcttgttccttacttgtattatctcatttaatcctcacaacagcctgtagtacagaaaactgtccccttccccaaaaaaatgtccttgtgcttctccccagaatatgttacattatgttgcaaaaggtattttgcagatttggttatgttgaggatgttgagatggggagagtatcctggatactctgtctcaaaaaa

SEQ ID NO: 265613 - DNA, 269 bp, Homo sapiens
ctggagtgcaggggtgtgatcccagctcactgcagcctccaactcctgggctcacacgatcctcctgcctcagcctcctaagtagctgggactacaggcatgtgccaccatcctcagctcagcttttaattttatatagagatgttatatataaacagatgttgcccatgctggtctcaaacttctggcctaaagggatcctcccacctcagctcctaaagtgctgggactacaggcatgaggctccatgcctggcccaccatgcctcc

SEQ ID NO: 265614 - DNA, 525 bp, Homo sapiens
tgtcttaattttgcatactttttttttctgtcaaatttgtcaatttttttaaaggattctggatttgggttgtgattagaaagaccttttacacttaaacgtattaaggaaagatctcgtgttccttctgaaaactttatagttattttctacctttaaatactttatctatttgcaatttatcctggtataagatgtaaggtatgaaaccaacttaattttcccctgtgagggcatcacagtctttttttaatcgcccatcttttccagactgcttgaagacattaactttaacttttattaaattccatgtttagtctatgtttttttcactttttaaatacttttctgttataccatattgacttaatgtctatttatgcaccccaataaaatggcattttggttactagggctttgtattattttctggtaaatttaattcactcattttttctttttacttctagaatttttcttttttttctattaaatataggaactgtagaatcagcttacttagtt

SEQ ID NO: 265615 - DNA, 472 bp, Homo sapiens
actttttcttaactactgcaaggaattaataaaagtgttaatctcaacatattgattataaatggagcaatatatatttttccaattaaattgggtcaatattaaatatgtttaaaatatatcagtattttgatcaagagcaatttattttgattgaattttaaatgtgggtttagttaatttgatggcaataagtttttcttaataatgttaagattgtaaaacaatttattatttccagagccaatattttgctaaagctacagtgaaatctcaaatgaatttcagaaatatcaataactcttaattgccaccaaaatacgatagctcttaacattttatagctacagttattaaggctgttaaactgcagatatccacattgaaatatttgttattacatctcctttggtgctgtttggtttgggggatgaaagaaaataaaatgctcaggattgagaagcatattaaa

SEQ ID NO: 265616 - DNA, 562 bp, Homo sapiens
caggaaaaaattaaaatatactgaaaactgtcctcttcccctcccctcccttcaattcattttctgttccattatggaaaaaaaaccccaaatttggaattttaatgttgtttttcctccattggttgtttagttagtgattttgccgacttcctggatgttcatttctggttctgcacaaaagagtcacatttccttttggaatcaggaccaggagacagaagcggactcgggaactgtgagtgccccccggtcttccccggcgcctctgaccccttcctccatctcgcagccttccctgccttcagcgcggagttccctttctccagggcttcttgtctgaactcaccccctcggctctcagcaccattctccacttttaggaaaagaaactctacaatttctatgcaaacatcggataagaaggggagggggagtgactttgattttcattttaagactctgaaagacggagaaagtaagcagaagcgggctggtgtatttcagaggctcccagtgagtccctactaaatttacctaataaaatgaatttttaaaattt

SEQ ID NO: 265617 - DNA, 354 bp, Homo sapiens
attccttagactccttaatcattctttggttaattacctcatttggccaagtaaataatcccggttttaaaatggaaccccaagttcacttttactaacaagttttatttctgtactatcagcttgttatctaagttctagttcatgtcagaggttcttcttgatatccagctattatttatgaggctgctgctgttatgaattaaggcaattctaacctagtctagatggcctcagctttccaaatacttcacttagaaggaaatatatgttttctctgctagaattctctgcatctgttttatttgctaccacagagaaaagaatgaaaaaagaaacaatacagagcattag

SEQ ID NO: 265618 - DNA, 358 bp, Homo sapiens
tcttaaggcaggaaaatgacgggtgtggtgggcttcctcaccactctcaagtgtatcactaactgtaacagcttttcaaaacaaaacagtacttacacctgaccacttagttcctggcaccaactattagatttacaatacagatggctcctcaacttacaatggattgtaagttgcaaatgggttgggcatggtggctcacacctgtagtcctaaacctctgggagtccaaggtgggagaatggcatgaacccgggaggtggagctggcagtgagccgagatcgcaccactgcactccagcctgggtgacacgactctgtctcaaaaacagacagagcaggactctgtctcaaaaaa

SEQ ID NO: 265619 - DNA, 393 bp, Homo sapiens
gagctgcttatataatttggtgaagataaagttaaaggtctttgtttcttccgcaatggaaagtgtgagtcattttaattacatgttcttagactggtgggacatacctggtttctttattcttgtctgtgtagtgctctagccaccaacacagtatgtctgcagaagatttaagaaagtatctaagcatttcctctcaaatgtatttgtgtcctagcaagcctacacatctctactaatgtgtgagaaatgaaactcatgcgcatagataaatctaatcttgatttttaggaagaagggagtagaaagcagtaccttaaagaatgcaggaacatgaaaaagatgcacagaagtgatatggaaagatcactaaaatataatgttaaatgaaaa

SEQ ID NO: 265620 - DNA, 368 bp, Homo sapiens
catttttctgggcaatggttttttaaatatttccccaaagcacaggcaacaaatgcaaaaataaataagattggatcaaactaaaaaacttctacacacaagggaaacaacctaatgaagtgataacctatggaatgggagaatatatttgcaaatgacacatctgacaaagggttaatacataaaatatgtaagaaatgcaaacaattcaatagcaagaaaacaaccccattgaaaaatgggcatagcaaggtgtggtggctcatggttgtaattccaacactttgggaggccaaggcaggtggatcattttaggtcaggagtttgagaccagcctgtctaacatggtgaaaccttgtctctactta

SEQ ID NO: 265621 - DNA, 818 bp, Homo sapiens
cagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcataagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccctgaatatgtaaaatgtatgtaatcctgcctattttctccttacttataatttattataattatgttggttctaataagaaccaatgcttattaaagttgagaaataagagtggtt

SEQ ID NO: 265622 - DNA, 596 bp, Homo sapiens
tttttttgtatttttagtagagacagggtttcaccttgttgctcaggctggtctaaaactcctggactcaagcgatctgcccgtctcggccttccaaagtgctgggattataagcatgagccaccacacccagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctttgactcttaaaaaatgccatgtcatgaaagatcaaaaaaagtagaggaatgttttagattaaaggaaatgaagacatgacatgcagtgcctaatctttgattggattctgtgctattctttcatctttctggtatgtttgaattttttttgaaatataaacttgggcaaaagagataaccaagataattgattaatttattgttatggctcattgggggcagtttcagagaaataaaaacaatctttgtaactggagtaaattct

SEQ ID NO: 265623 - DNA, 400 bp, Homo sapiens
aaattgctgcctcattctactgagaaaaagtttggtttaccatggttcagcctggagatccaggagtgaacaagatgatgaatgattgacaggagagacaacaagttcctggcctgcgtttcaccccagtggccgatgcatctgaaatgcctgcagttctcagctcttgaacagaactgaggagtcttgaaagaggccatggcatgccctgtggggtctccaggcagctttgataggcccagttggcatttgctataaaaacttattaaatccaggcctttcttctgcaactgagactccagaacagctgcccctgacaaacaataaagaagagctatcgaagtcacatcatgggctggaaccagaaaagaaaataataataaaaaaaataaaaaataaa

SEQ ID NO: 265624 - DNA, 217 bp, Homo sapiens
cccattgaaagtgtgcaggtgggggtctccgtacagccacagtgtcccgtagtgcatggggtagcaaccccagacacccctgtgctggcagcacagctcacagggcctgcaggcatgagggtggcactcgagcgggcgtccaggtccatggtacacgcacctctgatcacagggggctgcaggcagcacctcagtacccaggcggatatagcggccc

SEQ ID NO: 265625 - DNA, 352 bp, Homo sapiens
ccagtatattagtagcaaatattctgggctccagttccatctttgctattttctagtcatgtggtcttgggcacaacatttatctgtgttctgatttccttatcttttaaatgggaatgatatgacaacatacctgtcaacaattctgtgaggatcacatgaaattatacatgtgcaaatctaaaacattatatgaaaatagcttaatttcaatatatgctataatatggtatgaaagtttgtattccctattgggaagccaatcgatagtatttgtggttaaaagttatttttataatatacattaacatatataatataaaattattaaaaattatgattaaaaaatcaa

SEQ ID NO: 265626 - DNA, 371 bp, Homo sapiens
ttttccctagcaagggatcatctgtcaagtaggcactaagtttatctcatctaataataataaattggagcctgagtggttgacaataagaagataatttgtgactaatgtgtattgggctgctttatacttttgttttgttctggcaccattcttttctctactactcatccccattctaaacatcttgagcataaaacttattttttggtgtttagtctggagccatgctccaatatcagccttatctgatagaatgtgaagtaattacagcaattggaacgagctaattcagcagcattagaaagtttagaaattgaaacatccatcaagagaaggataaatagtgataaacttctacaatagaattc

SEQ ID NO: 265627 - DNA, 438 bp, Homo sapiens
aagatggggtaaactgagcaccagagagaggaagcaacctgcctcgggtgaccaggccatcagcaacagggcagagtggcacctgaagtgcctgacttccaggctgtgcttctctttctgtctcttgcctaccagcccctcgagcttgaaaaaagtgttcccatcacagtgggatgttgacagtcacatcactggctgacttggggttccttgaaagcccatcttcttccaccacagcaggcttcaaactttgtttaaaaatcccatggaggggcactgtggcctctgcctcctcagagcagtctctcaggggctgaggctttgctgattcaaagctatgtcatcactcgcagggaatctctgggggaggccatgccatgcccctactgtgggcatatttgggcaaagtcaataaactaggcccagatcaagtccagc

SEQ ID NO: 265628 - DNA, 300 bp, Homo sapiens
cccccaagcccaaaagcttcaattacccattgctctcgtccccaggtgatcagtttgaaattcagctaacccagcagctatggtccctcatccccaatgaggatgtgagaaggttcatgtctcatgttatctggaccttgaaaatggaatgttcagaaacacatgtgcaagggacctgtgccaagctcatgtcacgaacaggcctcctgatgaagcttctcagcgagcagcaggaagcaaaggcatccaaggcagaatggtctgtagaccaatggaaaactgatgagactccatcttaaa

SEQ ID NO: 265629 - DNA, 329 bp, Homo sapiens
tgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggtggcgaaaattttctcccatgttgtaggttgcctgttcactctgagggtagtttcttttgctgtgcttaaaatggcagaattttctcttgaacaatgagccttttgactctgtatccagtggtttttaaactcttccttctaaaattttagagttttctaccttgttctaaagtaagtg

SEQ ID NO: 265630 - DNA, 566 bp, Homo sapiens
agagaggcagaggaatcctagggagggggaagtgaggcatggacaggcagagggactgcactattcaagggcatgatggagagaagtacgtgcctggatttccaatttccctaaggataattttacaccagatcttctttattttaaaaatccaatccttttccttaataaccccatctgtccctgataccaccatttttttctaccagtctctcaggctagaaattttgtggttatctttgcctcttctctccttcatcctgtaaatcctacctgttgggaatacattactgtcctttcttcaaaatgttttatctgtcttttctttttcattctctgctattaactataacttcattctcagttccactgctgcctagctttctgtgccctgctagattcatcattattcatccaacaaacataaaaggaaaaaattggcctggcgcggtggctcacgcctgtaatcccagcactttgggaggccgaggcgggcggatcatgaggtcaggagatcaagaccatcctggctaacatggtgaaaccccgtctccactaaaaataca

SEQ ID NO: 265631 - DNA, 535 bp, Homo sapiens
agccagaaagagtgaaagaaatagaaccaaagtcatctcttaggagaagagaaataaatgcaccatctgaaaagtatccagtattcaagtaagttagacaaatgaaaaacattgcagcaagccattctctcaaatgaaaccaaatactaaaagataaacaccagagaaatagcaggtcagtatgtggaaaatatggggtagtacttttaacatattatccttggattaatgacatcagatattcaactgatcagagacagaatacttaatctcatcaaaaaagataagtagcaataagagaccttaaaatgatcactgaggccctccaacagcagctatttctgcagtcatgatcacacaatactgcatcctcattttctccctcccctggccctccaaaactttgtcatcacactctgaggaagagaatcactaagcgcagcctgcactcaagatgtacagagttaaactctgtatctctgggcagagggaagatctacataaattatttgagactctttctccaaaaaaaaaa

SEQ ID NO: 265632 - DNA, 373 bp, Homo sapiens
taatgccactgtcccttcacttgtaccccggatgtaactgtattcagctcaggtgccttcatcagcaggagcactgtaagcgtaatttattaaaagtgaaacaattgtacaagcagttaatcaaccaccacagggcataattaatgaagcagccttcccctccccacccccattgattttgtgaaactccctttttctttcagcttgatcaagtattccaaatttagaaagctctaaggtggcctacagaaaaagaaaaaggccacataaggtccctctgactttcagtaaatagcagcatataaatacaagaaaaaatagatattgtcttgtgcagcattaaaaaatcaaaataaaataaatatgagcaaaa

SEQ ID NO: 265633 - DNA, 382 bp, Homo sapiens
taaccacatttgcaaacatttgcaataaagtgaaattagttacaaaagaagtgtgaaaagggaattaggctgagccacagaaaattgccaaaattcaatccttttagaactccataacagcaatttcctatggctcaacctaaattctaaaggaagttaaggatgaaaccattaatctaagttgtgggagggctgcagggggagtcctggaacgtcagaaagaagttgcagcatttgagcaatgcgccaaggaacttagcagtctcagccaactggccggtgctgctgaagccagagacagtgggtgcagtgagtagtgagttgtaggtggagaagtgaaatcaagtgagtgtaggcttttatgatgtttgaaagtgaaggg

SEQ ID NO: 265634 - DNA, 461 bp, Homo sapiens
tgacaaaagtatttcaggagtttggcaatgaaaccttgtatttattatgaaacatgtatcctctggtgtctagaacagagcactttctgaggctcaagaaagatacatagcaatgagtagatggaaccatcttcctgtctcagaactgagccaagtcatttaccagttgtacctggtcagctctttggggaagctttcaaaagaggcagattccagcttagaaaaagcatcagtgcactctgaatccctaagatcattaccagggccttcatggtatgttataaaaactggagaacatctagatgagctgatgagttgctaccgtgtctaggtttatgttttatggtggccaaaacaaatgaaaaacaactataagtactgtgtttggcatcagtactacatgatagcgaatcataacaatgagactgaaaaggtgacaaagtaacctaaaagcagataaa

SEQ ID NO: 265635 - DNA, 390 bp, Homo sapiens
cccattttacagatgacttgtccaagatcacatgagtagtaagtagcaaagccagaattcaagttcaggtaaacctgacttcttagtggggccagtttcacgggtgtgtggcctgtgcagtcacacagagttctgcactgaagagggcctccacttggtttaatgttctgctgtgactctcttgaacttctgatatttttttaaacaatgaacttatattttagaccctctgaattctttcgctggtcctgcttgagactgtgtttctagtggtgccatgtctactggaatagaagtacaatagttagtgcagtgcctggcccaggagctcctcaaaaacaggaattccatttccttccctctaacctctgcttctttaacaaagcagcc

SEQ ID NO: 265636 - DNA, 518 bp, Homo sapiens
catcaaacaggccgggcacagtggctcacacctgtaatcccagccctttgggaggccaaggagtgcggatcacctgaggtcaggagttcgagaccagcccgaccaacatggtaaaacctcgtctctattaaaaatacaaaaattagccgggcatggtggtaggcgcctgtaatcccagctattcaggaggctgaggcatgagaattgcttgaacccagaaggcggagattgcaccactgcactccagcctgggggatacagcaagactctgtctccaaaaacaaacaaataaaaaaaaaaatcaaacaatgctcgggggaaccctcagcttttgaatgtacatattgtgtacatatctgagttcataagataataaagggccaaaaatgaagacaaaactgaaaaccagagcatttaagaataagcattaatgctatggcagcatgagaataagagagtgaagtacattgccagtattagtattgtatcccagagacttgaaattttatgcccacgta

SEQ ID NO: 265637 - DNA, 222 bp, Homo sapiens
gagaaattctggcagacagaccttgcctccccaactgataaagtccagccaaagctgtggtggcttggagagaggtggggtctctggagtcttgtcctttgatgatgatagtgatgcagttccccaatttgggaaaaataacatttatgaagagaaaatgcatggtcataggaaaaaactggaaaacctcttcacgaataaacatggcatttttagtcatca

SEQ ID NO: 265638 - DNA, 400 bp, Homo sapiens
gccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgacca

SEQ ID NO: 265639 - DNA, 587 bp, Homo sapiens
ctttcaggaaatccagcctattcaaggaacatttccaatcctctgggtaggaggtttaaaacatctgcctagtctaatattgaaaggccaatgactgctaatgacaggccaatgactgccatatgtttcccattcttctgctttttaatgtgagtatttgttgaaggtatcttgactctgttctactactggataatgtgtgagtgggaggtgggagggccaggtctctggatcaaaaggagatatacacagacctattttacaggctccttcacattatcccctgacataaagactaccatgcgtcatccagggatcctgggttttgaaattgatgccatcactgagacttttgagttttcttccctcagaggaaagtgaatgaatgcattttgtacatgggaagaaagatgaaggaaatacttcatgccctgaagtgaagactgcaattatcattagtactattcaccaaatatttctgctttactgcctcatgacaggattgcacttcccctccccatcttttaaaggtaggcataactatgtaacttgctttggctaattaaatgtgaacagaagtgatgtgt

SEQ ID NO: 265640 - DNA, 581 bp, Homo sapiens
tacagccagtgcatttagtgcatgatattttaagtttcctctttggaaacagcattcagagattaatcatggtcagtttagagcccagtagggtagtcatctcatggcctcatggtgcagttacaagttcaggttaccctaagcatctttgtttttttataatatggattctaaataaataagtgtggctgtttttgaaaatttggaaatcacagactgtcccagacttaaactataatttgacttaaaaattttcaactttgcgatgttgcaagtgctgtatgtatactttgagtacccatacaaccgttctgttttttcactgtattcagtaaattacatgagatactcaacattctattataaaataggttttgtgttgggtgattttgtccaaccgtaggtcttacctctgtaagtgtttggagcacatctaaggtaggctaggctaagctgtgatgtttggtagattagatgtatgaaatgcgtttttggcttaattatattttcagcttactatgggtttatcaggctgtaaccccataataagttgaggcactcctgcatctgtgaagtttaaa

SEQ ID NO: 265641 - DNA, 204 bp, Homo sapiens
tccagggccccttgctggctggcttacatggaatgttccagcctctgtttgaaagtttccactgagaggaaccactgcatcaggcttatcaaataatacaacgtctgaccaagggttgggatttgttggctgtaataatgactccattctgattttggtaataataaaagtgactgtgagaatgtcattcctaacctaaggaag

SEQ ID NO: 265642 - DNA, 293 bp, Homo sapiens
ttcaaactcagcattttggccctactgtcctgttccagaacagactgaccactgctgggggtagggggttggggggacccttggaattggaactcaccccagaagcagtggagagtctctgcctccaaagacgacactgagttctttctcccaagaagtccacccacggatgaccagagaaggtggaggaccagctcctacagaggtcagaagcacagccagacatcgtccccaacccaagattcagaacataatggtttgaaaaacggacctcagcagtccgggcagagttt

SEQ ID NO: 265643 - DNA, 223 bp, Homo sapiens
gtgagacccggcaggtcaggcttcttccccagaagcagtggagagtctctgcctccaaagacgacactgagttctttctcccaagaagtccacccacggatgaccagagaaggtggaggaccagctcctacagaggtcagaagcacagccagacatcgtccccaacccaagattcagaacataatggtttgaaaaacggacctcagcagtccgggcagagttt

SEQ ID NO: 265644 - DNA, 315 bp, Homo sapiens
ttgaccactctatgccacttaattggagaattcagtctatttactttcagtgttattgttgagagctaaggaggtactactgtcatattgttacttgttttttggttgatttgtaacttctcttttccttttttccaccttacttactgtcttcctttgtggttacgtaattttctttgataatatttttaaatgtgttgcattttatttttggtgtatctatgatagggttttgctttgtggttatcatgaggcttacaaaaatatcttaaagatataaacagttattgtaaacagacaattttgaccattaag

SEQ ID NO: 265645 - DNA, 234 bp, Homo sapiens
agtgggggaagtcctcaacacctcttattctccctactatggacccggtgccaggatgaatgagtcacagtccctgccctcacagtcagctgggacaggcaccacttgacggaggaactgccacaccaggggcttcctcctgccacccagagtgctggggggcgagcccaggagccaggaactctgcccaagtgcaccagggaatgccctggagaggagaagtttgagaggagt

SEQ ID NO: 265646 - DNA, 451 bp, Homo sapiens
tacctggcaaaaacaaacacacagatactgccttcatgggaatatcatcaatataggcccatctatagattcctatagctaaaatgctgctgattatgatcacacaattcaaaattacattatatgagcagtagtcagcagcaatgacacggttcttaagtaataaaagagagaatctaggtctgggcatggtggctcatgcctgtaatcccagcactttgggaggccgacgtgggtggatcacctgaggtcaggagttcaagaccagcctggccaacatggcgaagccctgtctctactaaaaaatacaaaaattagctgggtgtggtggcgggtgcctgtaatcccagctagttggaaggctgcgacatgagaatcactggaacctgggaggtggaggttgcagtgagctgagactgtgccactgcactccagcctgggcaacagagca

SEQ ID NO: 265647 - DNA, 310 bp, Homo sapiens
tattccctggcagttctacagggcctggagctgatacgaaaaacctcccttctttcccaaatggtccccagcttccccgttcactgaaggccctgcagtcgggaacagtcaggactttgcacccagttgttgtgggtgtttggccaacccttcctcttgtgtgattcatggacctgcagcattgcgtcacctgtgagcttttggaattgaagactctcagggctcacccgggaggacctgctgggccagaatctgcattttaacaagatgcctgggtgatctgcatacacgttcagatctgagaagtgct

SEQ ID NO: 265648 - DNA, 1714 bp, Homo sapiens
tgtctatagtaggtgcggagaagaaatgtttggcagatgaagaaaatgaggtgcagagaggatttaagagattctctcttactgcctgttcagggtcagtccagaattgagggtctccgggggagggcagaggctttgccctgcaggggatctgtgggagggggttaggagggagcagatgagcccaggatgaatggtcagagtcaggtgctgcccggcggaggtcacgagtccagggaggggatcaacatggccgctgcaccccggactgtgttgatctccggctgctcatcaggaattggtctggaacttgcagtgcaactggcccatgaccccaagaagcgctaccaggtcgtggccaccatgagggacctggggaagaaggagacactggaggcagctgctggggaggctctggggcagaccctcaccgtggcccagctggacgtgtgcagtgatgagtcggtggcccagtgtctcagctgtatccagggagaagtggacgtgctggtgaataatgctggaatgggcctggtggggcccctggaggggctcagccttgctgccatgcagaatgtctttgacaccaactttttcggagctgtccgtctcgtcaaagctgtgcttccaggcatgaagaggaggcggcagggccacatcgtggtgatcagcagtgtcatgggcctgcagggtgtcatcttcaacgatgtctatgcagcttccaagttcgccctggagggattcttcgaaagcctcgctatccagctgctgcagttcaacatcttcatctccctggtggagccaggccccgtggtcaccgagtttgaggggaagcttctggcgcaggtttctatggctgagttcccaggcactgaccctgagaccctgcactacttccgggacctctatctcccagcctccaggaagctgttttgctccgtgggacagaacccacaggacgtggttcaggccattgtcaacgtcatcagctcgactcgaccacccctgcgccgacagaccaacatccgctactcgccgctgaccacgctcaaaaccgtggattcctctggcagcctgtatgtgcgaacgacccaccgcctcctcttccgctgtccacgcctcctcaaccttggccttcaatgtctgtcctgcggctgcctcccaacgcgggtgcggccaagatgagcagaacagagcttcacgatccccatccctgaacaaccagacctcttcattccacatctaattcaaaggatgaacagactcttcatttattcattctgcaaactccccctcccctcctctgtgcctagacatggctagaatcccagaagggcctttattttcaggcatagactcctctgtggtcacagctggagcacagagagggaccctgggaacttggcctgggaagcccagagcaggaagccacagctgtctctgggaaagcaagggaggcttcctggaggaagcggcattgttatgagccttgaaggaagagacagactctgctacattcaacctcgtgacttcatgatcctgggcctgagaacacaggaatgattcatagcccaccccccacctccatgcatacaccagagctctgtggaccaaggggtcattcctggtcacacactccatcagcaaaatgtatttgagcacacaccagcaatgtatgtatattttttccattaaatatatatttataaccaca

SEQ ID NO: 265649 - DNA, 965 bp, Homo sapiens
tgtctatagtaggtgcggagaagaaatgtttggcagatgaagaaaatgaggtgcagagaggatttaagagattctctcttactgcctgttcagggtcagtccagaattgagggtctccgggggagggcagaggctttgccctgcaggggatctgtgggagggggttaggagggagcagatgagcccaggatgaatggtcagagtcaggtgctgcccggcggaggtcacgagtccagggaggggatcaacatggccgctgcaccccggactgtgttgatctccggctgctcatcaggaattggtctggaacttgcagtgcaactggcccatgaccccaagaagcgctaccaggtcgtggccaccatgagggacctggggaagaaggagacactggaggcagctgctggggaggctctggggcagaccctcaccgtggcccagctggacgtgtgcagtgatgagtcggtggcccagtgtctcagctgtatccagggagaagtggacgtgctggtgaataatgctggaatgggcctggtggggcccctggaggggctcagccttgctgccatgcagaatgtctttgacaccaactttttcggagctgtccgtctcgtcaaagctgtgcttccaggcatgaagaggaggcggcagggccacatcgtggtgatcagcagtgtcatgggcctgcagggtgtcatcttcaacgatgtctatgcagcttccaagttcgccctggagggattcttcgaaagcctcgctatccagctgctgcagttcaacatcttgtttctatggctgagttcccaggcactgaccctgagaccctgcactacttccgggacctctatctcccagcctccaggaagctgttttgctccgtgggacagaacccacaggacgtggttcaggcctggtcccggtttcggcgagtgggccccctgggcggggacccatcggaaccgcga

SEQ ID NO: 265650 - DNA, 359 bp, Homo sapiens
tgagtcattcccttttcctttgaaagtatgttaaagaatctaccagtttatagttttctaaaaattgagaaaataaggaaaggaaatgaaagtcataacctaatcaccaatacatttgaacagttttatttccttggagataacaggagaaaaaatgttttagcttacctctaaaattgatggaaacctaattttaaatcctctataattctgtaaaagttaattctaaggaattcaagtcagggttaattaactttaaatgtacgctgcaagtcataccaaatgtatttcacgttggtttctctgattattcatggtctttatacttgaattatagatagatatatcacattttagaa

SEQ ID NO: 265651 - DNA, 881 bp, Homo sapiens
gcggccgctctcacttcagattggtaacgtgggagcggcgctggcccctggggctagggctggtgctgctgctctgcgccccgctgcccccgggggctcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtgctgcttccctccatgccatctgggtcctggtgcagatccctggtggctccttattgggtgccagagaaggttgcagagacaggaagagggtgcagaggtagaatcttgaaaagaatttggcgcttgaaggctgggcatggtggcttgtgcctgtaattccagtgctttgggaaaccgatgtgggaagatcacttgaggccaggagcttgagaccagcctgggcaacatagcaaaacttcatctctgcaaaaaattaaaaatcacctgggcatggtggcccatacctgtagtcccagcgactcaggaggctgaggcaggaggatcacttgagcccaggagtttgaggctgcagtgatctatgattgtgccactgtacaccagcctgggcaacagagcaagatcctgtctctaaagaaa
